(12) United States Patent
Ma et al.

(10) Patent No.: US 6,759,226 B1
(45) Date of Patent: Jul. 6, 2004

(54) ENZYMES FOR THE DETECTION OF SPECIFIC NUCLEIC ACID SEQUENCES

(75) Inventors: Wu-Po Ma, Madison, WI (US); Victor I. Lyamichev, Madison, WI (US); Michael W. Kaiser, Madison, WI (US); Natalie E. Lyamicheva, Madison, WI (US); Hatim Taysir Allawi, Madison, WI (US); James J. Schaefer, Madison, WI (US); Bruce P. Neri, Madison, WI (US)

(73) Assignee: Third Wave Technologies, Inc., Madison, WI (US)

( * ) Notice: Subject to any disclaimer, the term of this patent is extended or adjusted under 35 U.S.C. 154(b) by 0 days.

(21) Appl. No.: 09/577,304

(22) Filed: May 24, 2000

(51) Int. Cl.[7] ............................ C12N 9/22; C12P 19/34
(52) U.S. Cl. ...................................... 435/199; 435/91.1
(58) Field of Search ................................ 435/199, 471, 435/91.1, 975

(56) References Cited

U.S. PATENT DOCUMENTS

| 5,244,797 A | 9/1993 | Kotewicz et al. ........... 435/194 |
| 5,268,289 A | 12/1993 | Dahl et al. .................. 435/199 |
| 5,459,055 A | 10/1995 | Jendrisak et al. ........... 435/199 |
| 5,466,591 A | 11/1995 | Abramson et al. .......... 435/194 |
| 5,500,370 A | 3/1996 | Jendrisak et al. ........ 435/320.1 |
| 5,541,311 A | 7/1996 | Dahlberg et al. ........... 536/23.7 |
| 5,614,402 A | * 3/1997 | Dahlberg et al. ........... 435/199 |
| 5,795,762 A | 8/1998 | Abramson et al. .......... 435/194 |
| 5,795,763 A | 8/1998 | Dahlberg et al. ........... 435/194 |
| 5,837,458 A | 11/1998 | Minshull et al. ............... 435/6 |
| 5,843,669 A | 12/1998 | Kaiser et al. .................. 435/6 |
| 5,846,717 A | * 12/1998 | Brow et al. ..................... 435/6 |
| 5,874,283 A | 2/1999 | Harrington et al. ....... 435/252.3 |
| 5,985,557 A | 11/1999 | Prudent et al. ................ 435/6 |
| 5,994,069 A | 11/1999 | Hall et al. ...................... 435/6 |
| 6,001,567 A | 12/1999 | Brow et al. ..................... 435/6 |
| 6,090,606 A | 7/2000 | Kaiser et al. ............... 435/199 |

FOREIGN PATENT DOCUMENTS

| WO | WO 97/27214 | 9/1997 |
| WO | WO 98/27230 | 6/1998 |
| WO | WO 98/31837 | 7/1998 |
| WO | WO 98/42873 | 10/1998 |
| WO | WO 99/65927 | 12/1999 |
| WO | WO 00/18906 | 4/2000 |

OTHER PUBLICATIONS

Kaiser et al., J. Biol. Chem., 274:21387 [1999].
Lyamichev et al., Nat. Biotechnol., 17:292 [1999].
Lyamichev et al., Science 260:788 [1993].
Kwiatkowski et al., Molec. Diagn., 4:353 [1999].
Xu et al., J. Biol. Chem., published online as 10.1074/jbc.M909135199 at www.jbc.org/pips/pips.2.shtml, May 9, 2000.
Doherty et al., Nucl. Acid. Res., 24:2488 [1996].
Marmur and Lane, Proc. Natl. Acad. Sci. USA 46:453 [1960].
Doty et al., Proc. Natl. Acad. Sci. USA 46:461 [1960].
Nielsen et al., Anticancer Drug Des. 8:53 [1993].
Mullis and Faloona, Methods in Enzymology, 155:335 [1987].
Saiki et al., Science 230:489 [1985].
Eom et al., Nature 382:278 [1996].
Minnick et al., J. Biol. Chem., 271:24954 [1996].
Polesky et al., J. Biol. Chem., 267:8417 [1992].
Kiefer et al., Nature 391:304 [1998].
Ollis et al., Nature 313:762 [1985].
Kim et al., Nature 376:612 [1995].
Korolev et al., Proc. Natl. Acad. Sci, 92:9264 [1995].
Doublie et al., Nature 391:251 [1998].
Pelletier et al., Science 264:1891 [1994].
Ceska et al., Nature 382:90 [1996].
Del Rio et al., Biotechniques 17:1132 [1994].
M.J.R. Stark, Gene 5:255 [1987].
Studier and Moffatt, J. Mol. Biol., 189:113 [1986].
Sambrook et al. Molecular Cloning, Cold Spring Harbor Laboratory Press, Cold Spring Harbor, pp. 1.63–1.69 [1989].
Engelke et al., Anal. Biochem., 191:396 [1990].
Myers and Gelfand, Biochemistry 30:7661 [1991].
Johnson et al., Science 269:238 [1995].
Higuchi, in PCR Technology, H. A. Erlich, ed., Stockton Press, New York. pp61–70 [1989].
Brautigam et al., Curr. Opin Struc Biol. 8(2):54–63 (1998)(Abstract Only).
Urs et al., Acta Crystallogr D. Biol. Crystallogr 55(Pt 12):1971–7 (1999)(Abstract Only).
Hall et al., PNAS 97:8272–8277 (2000).
Xu et al., J Biol. Chem. 275:20949–20955 (2000).
Van Deuren et al., J. Inf. Dis., 169:157 [1994].
Perenboom et al., Eur. J. Clin. Invest., 26:159 [1996].
Guidotti et al., Immunity 4:25 [1996].
Grant et al., Transplantation 62:910 [1996].
Mellors et al., Science 272:1167 [1996].
Saag et al., Nature Medicine 2:625 [1996].
Lyamichev et al., Prot. Natl. Acad. Sci., 96:6143 [1999].
Li et al.., Protein Sci., 7:1116 [1998].
Joyce and Steitz, Trends in Biochemical Science 12:288 [1987].
Breese et al., Science 260:352 [1993].
Polesky et al., J. Biol. Chem., 265:14579 [1990].
Pandey et al., Eur. J. Biochem., 214:59 [1993].
Holm and Sander, J. Mol. Biol., 233:123 [1993].
Holm and Sander, Science 273:595 [1996].
Li et al., EMBO J., 17:7514(1998).
May et al., Proc. Natl. Acad. Sci., 83:8957 [1986].

* cited by examiner

Primary Examiner—Charles L. Patterson, Jr.
(74) Attorney, Agent, or Firm—Medlen & Carroll, LLP

(57) ABSTRACT

The present invention relates to novel enzymes designed for direct detection, characterization and quantitation of nucleic acids, particularly RNA. The present invention provides enzymes that recognize specific nucleic acid cleavage structures formed on a target RNA sequence and that cleave the nucleic acid cleavage structure in a site-specific manner to produce non-target cleavage products. The present invention provides enzymes having an improved ability to specifically cleave a DNA member of a complex comprising DNA and RNA nucleic acid strands.

21 Claims, 37 Drawing Sheets

```
MAJORITY [SEQ ID NO:7]  TCCAGGCCCACATGGAXGACCTGAXGCTCTCCTGGGAGCTXTCCCAGGTGCGCACCGACCTGCCCCTGGA

DNAPTAQ [SEQ ID NO:1]   ....T.............C..T......A...............C..GG..A................    764
DNAPTFL [SEQ ID NO:2]   ........GGG......G..C......GCC..T...C..A....T.............A..T......    761
DNAPTTH [SEQ ID NO:3]   ....A............A....C.G.................T......C......G.........C    770

MAJORITY                GGTGGACTTCGGCCAAGXGGCGGGAGCCCACCGGGAGGGGCTTAGGGCCCTTTCTGGAGAGGCTGGAGTTT

DNAPTAQ                 ................AA....A.............................................    834
DNAPTFL                 ........GG.G..C..C...CACA....A...T......T..GC....T...T......C..T.....    831
DNAPTTH                 ......C......C...G.............................C...................C    840

MAJORITY                GGCAGCCTCCTCCACCGAGTTCGGCCTCCTGGAGGGCCCCAAGGCCCTGGAGGAGCCCCCTGGCCCCGGC

DNAPTAQ                 ................T....AA.......................T......................    904
DNAPTFL                 ..A..................T.........G..C.....G.C....GGCA..................T    901
DNAPTTH                 ..............................C.....GCCC............................    910

MAJORITY                CGGAAGGGGCCTTCGTGGGCTTTGTCCTTTCCCCCCCGAGCCCATGTGGGCCGAGCTTCTGGCCCTGGC

DNAPTAQ                 ................T..TT........G...............AAG......T..............    974
DNAPTFL                 ..............T..TT........TC.T....T......C.................G...AAA...    971
DNAPTTH                 ...............................C............................G...AAA...    980

MAJORITY                CGCCCCGAGGAGGGCCGGGTCCACCCGGCACCAGACCCCCTTTAXGGGCCTXAGGACCTXAAGGAGGTG

DNAPTAQ                 ........G.....................C..C..G..T.A..AA.C......C..............C    1044
DNAPTFL                 T.GG..GT......G..CC...T........A.........C..G......T..........T..G....    1041
DNAPTTH                 ...TG.....C...............G.........GCC...G..A..A............C......C    1050
```

Sequence alignment figure showing DNA sequences for MAJORITY [SEQ ID NO:7], DNAPTAO [SEQ ID NO:1], DNAPTFL [SEQ ID NO:2], and DNAPTTB [SEQ ID NO:3], with position numbers 1464/1461/1470, 1534/1531/1540, 1604/1601/1610, 1674/1671/1680, and 1744/1741/1750.

FIG. 8F

```
MAJORITY [SEQ ID NO:7]  AGAACATCCCCGTCCGCACCCCXCTGGGCCAGAGGATCCGCCGGGCCTTCGTGCCCGAGGAGGGXTGGGT

DNAPTAQ [SEQ ID NO:1]   ...............................G..T..G...............A.C...........G...C.   1814
DNAPTFL [SEQ ID NO:2]   ..............................G.....T.........C.C...........A.........C......   1811
DNAPTTH [SEQ ID NO:3]   .............................CT................................C...T.....C   1820

MAJORITY                GTGGTGGCCCTGGACTATAGGCAGATAGAGCTCCGGGTCCTGCCCACCTCTCGGGGACGAGAACCTG

DNAPTAQ                 A..........................A...G..............C..........
DNAPTFL                 .C......T.T.......C........T...T........................
DNAPTTH                 ...A....................................C........A......

MAJORITY                ATCCGGGTCTTCCAGGAGGGGAGGGACATCCACACCCAGAGACCCAGCTGGATGTTCGGCCTCCCCCGG

DNAPTAQ                 ................C.............GG.........................G...       1954
DNAPTFL                 ......T.....................................................TT.....C.   1951
DNAPTTH                 ...A.....................A...............................           1960

MAJORITY                AGGCCGGTGGACCCCTGATGCCCGGGGCCGGGCCAAGACCATCAACTTCGGGGTCCTCTACGGCATGTCCGC

DNAPTAQ                 ..........................................................G...           2024
DNAPTFL                 .A.GG..A...T..........................................GG.G............        2021
DNAPTTH                 .....A............................................C..................      2030

MAJORITY                CCACCGCCCTCTCCCAGGAGCTTGCCATCCCCTACGAGGAGGCGGTGCCCTTCATTGAGCGCTACTTCCAG

DNAPTAQ                 ...........................A..........T.............CCA............T...      2094
DNAPTFL                 ..........GG.............T..............................................   2091
DNAPTTH                 ...TA.G..................................T.A...............A          2100
```

FIG. 8G

```
MAJORITY [SEQ ID NO:7]  AGCTTCCCCAAGGTGCGGGCCTGGATTGAGAAGAGACCCTGGAGGAGGGCCAGGAGGGGGGGTACCTGGAGA

DNAPTAO [SEQ ID NO:1]   ..........................................................A.............  2164
DNAPTFL [SEQ ID NO:2]   ....A..............................C.............C.CC.....T............  2161
DNAPTTH [SEQ ID NO:3]   ..........................A..A....................G....A....C......A...  2170

MAJORITY                CCCTCTTCGGCCGCGGGGCTACGTGCCCGACCTCAACGCCCGGGTGAAGAGCGTGCGGGAGGCGGCGGA

DNAPTAO                 .................C.....................A....AG.G..................C......  2234
DNAPTFL                 .........T....................................................C..........  2231
DNAPTTH                 ..AA.AA..............................................CA.........C.......  2240

MAJORITY                GCGGCATGGCCTTCAACATGCCCGTCCAGGGCACCGCCGACCTCATGAAGCTGGCCATGGTGAAGCTC

DNAPTAO                 .....................G..................................T..............  2304
DNAPTFL                 .......................................................CG...T..........  2301
DNAPTTH                 ..................................................C.....................  2310

MAJORITY                TTCCCCGGCTXCAGGAAATGGGGCCAGGATGCTCCTXCAGGTCCACGACCAGCTGGTCCTCGGAGGCCC

DNAPTAO                 ....A....GG....................T...........................................  2374
DNAPTFL                 .........T......C..........G..........TT.G.....G............................  2371
DNAPTTH                 ...C..C.G....G..............C.C.........C...............CC......G..........  2380

MAJORITY                CCAAAGACGGGGCGGAGCXGGTGGCCGCGCTTTGGCCAAGGAGGTCATGGAGGGGTCTATCCCCTGGCCGT

DNAPTAO                 ..A........A.......CC....CGGC........................G..................  2444
DNAPTFL                 ..G..C.......AG....A....................................GG....CAG.......  2441
DNAPTTH                 ..C.....C......A.....G.................C............AA..C........C......  2450
```

```
                                                    2499
                                                    2496
                                                    2505

MAJORITY [SEQ ID NO:7]  GCCCCTGGAGGTGGAGGTGGGATGGGGAGGACTGGCTCTCCCCAAGGAGTAG

DNAPTAQ  [SEQ ID NO:1]  ..................A...........................GA
DNAPTFL  [SEQ ID NO:2]  .......................CC........................
DNAPTTH  [SEQ ID NO:3]  ...................................T......GT....
```

```
MAJORITY [SEQ ID NO:8] MXAMLPLFEPKGRVLLVDGHHLAYRTFFALKGLTTSRGEPVQAVYGFAKSLLKALKEDG-DAVXVVFDAK

TAQ PRO [SEQ ID NO:4] ........................H...........................................RG............I.........    69
TFL PRO [SEQ ID NO:5] ........................................................................V.V.........    68
TTH PRO [SEQ ID NO:6] ....E...................................................................YK.F.........    70

MAJORITY              APSFRHEAYEAYKAGRAPTPEDFPROLAIKELVQLLGLXRLEVPGYEADDVLATLAKKAEKEGYEVRIL

TAQ PRO               .....................GG.....................................A.......................  139
TFL PRO               ...........................................V..........F............S................  138
TTH PRO               ....................................................FT......................R........  140

MAJORITY              TADRDLYQLLSDRIAVLHPEGYLITPAWLWEKYGLRPEQWVDYRALXGDPSDNLPGVKGIGEKTAXKLLX

TAQ PRO               ...K.....................H.................................D.A....T.E...........R...E  209
TFL PRO               .........E..I............................Y.................A......I........OR.IR      208
TTH PRO               .....V...V...............H...E...........................F..V...............L....K   210

MAJORITY              EWGSLENLLKNLDRVKP-XXREKIXAHMEDLXLSXXLSXVRTDLPLEVDFAXRREPDREGLRAFLERLEF

TAQ PRO               .......A........L...AI....L...D..K..WD.AK..............K..........R............      278
TFL PRO               .......FQH..Q....SL...LQ.G..A.A..RK..Q.H...........OR..T.NL..................    277
TTH PRO               ......ENV....K.L...R..LE..R..........................L.QG..................   280

MAJORITY              GSLLHEFGLLEXPKALEEAPWPPPEGAFVGFVLSRPEPMWAELLALAAARXGRVHRAXDPLXGLRDLKEV

TAQ PRO               .......S.........................K....D........G........PE.YKA.....A   348
TFL PRO               .......G...A..........L.SF................G.WE.L..Q..R....G.         347
TTH PRO               .......A.AP...........................K..C.D........A..A..K....     350
```

FIG. 9B

Sequence alignment figure showing protein sequence comparisons between TAQ PRO, TFL PRO, and TTH PRO with MAJORITY consensus sequences (SEQ ID NO:8, SEQ ID NO:4, SEQ ID NO:5, SEQ ID NO:6). Positions numbered 418/417/420, 488/487/490, 558/557/560, 628/627/630, and 698/697/700.

FIG. 9C

```
MAJORITY [SEQ ID NO:8]   SFPKVRAWIEKTLEEGRRRGYVETLFGRRRYVPDLNARVKSVREAAERMAFNMPVQGTAADLMKLAMVKL

TAQ PRO  [SEQ ID NO:4]   ..........................................E...........................  768
TFL PRO  [SEQ ID NO:5]   .Y........G............................................................  767
TTH PRO  [SEQ ID NO:6]   ..........K.............................................R.............  770

MAJORITY                 FPRLXEMGARMLLQVHDELVLEAPKXRAEXVAALAKEVMEGVYPLAVPLEVEVGXGEDWLSAKEX

TAQ PRO                  ....E...............E...A...R...................I...............        833
TFL PRO                  Q..L................D...R........W..Q...............L..M........        831
TTH PRO                  R...................QA..E...........A..KA...........M..........G        835
```

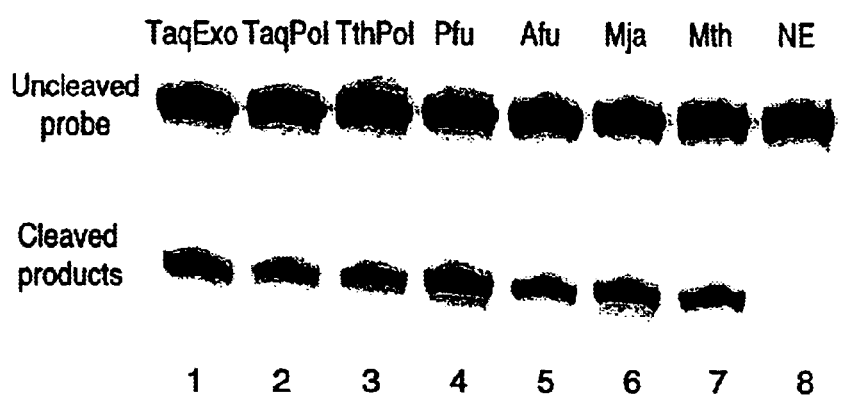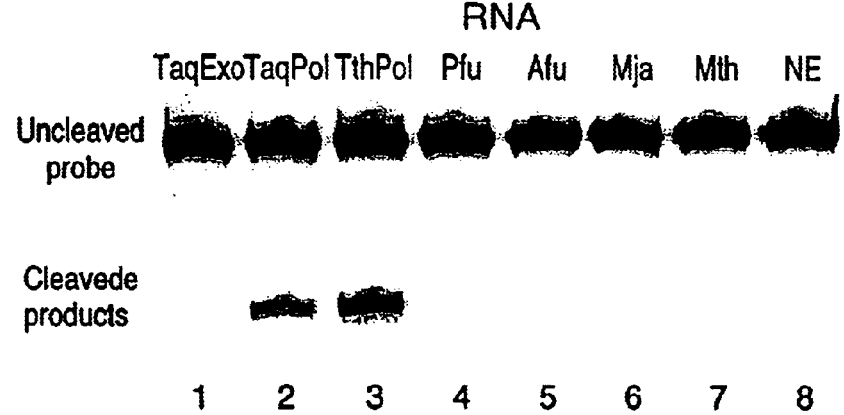
FIGURE 11

```
                              BstBI (382)                                                                    NdeI (443)
                                 |            390       400       410        420        430        440        450       460
           1 TaqPol           DPSNTTPEGVARRYGGEWTEEAGERAALSERLRRNLWRLEGEERLLWLYREVERPLSEVLAHMEATGVREDVAYLRALS
           2 TthPol           DPSNTTPEGVARRYGGEWTEDAAERALLSERLENLLKRLEGEEKLLWLYHEVEKPLSEVLAHMEATGVREDVAYLRALS
                              +            +         +         +        ++        +          +          +         +

470       480       490       500       510        520        530       540
           1 TaqPol           LEVAEEIRLEEEVFRLAGHPFNLNSRDQLERVLFDELGLPAIGKTEKTGKRSTSAAVLEALREAHPIVEKILQHRELTK
           2 TthPol           LELAEEIRLEEEVFRLAGHPFNLNSRDQLERVLFDELRLPALGKTEKTGKRSTSAAVLEALREAHPIVEKILQHRELTK
                              +    +                                +    +                              +    +

BamHI (593)
                               550       560       570        580       590  |
           1 TaqPol           LKSTYIDPLPGLIHPRTGRLHTRFNQTATATGRLSSSDPNLQNIPVRTPLGQRI
           2 TthPol           LKNTYVDPLPSLVHPRTGRLHTRFNQTATATGRLSSSDPNLQNIPVRTPLGQRI
                              +  + +    + +
                              +    +
```

FIGURE 13

| | | Polymerase Activity Assays |
|---|---|---|
| | | % Fl-labeled dUTP incorporated |
| Nuclease Domain | Polymerase Domain | RNA, p(A)   or   DNA, p(dA) Template |
| Tth | | 5.8 (1.00)      14.8 (1.00) |
| Taq | | 0.8 (0.14)      15.0 (1.01) |
| TaqTth(N) | | 4.88 (0.84)     12.9 (0.87) |
| TaqTth(N-B) | | 0.58 (0.10)     13.3 (0.90) |
| TaqTth(B-S) | | 6.60 (1.14)     14.9 (1.01) |
| Taq(W417L/G418K/E507Q) | | 0.42 (0.07)     12.6 (0.85) |

```
         5'-tet-TTTT
                   CAACTGCCGTGA
     A
    A CGAGGCGCACG
       GGCTCCGCGTGGTTGACGGCACT
```

B

```
         5'-tet-TTTT
                   CAACTGCCGTGA
     A
    A CGAGGCGCACG
       GGCUCCGCGUGGUUGACGGCACU-BiotinSA-5'
```

FIGURE 22
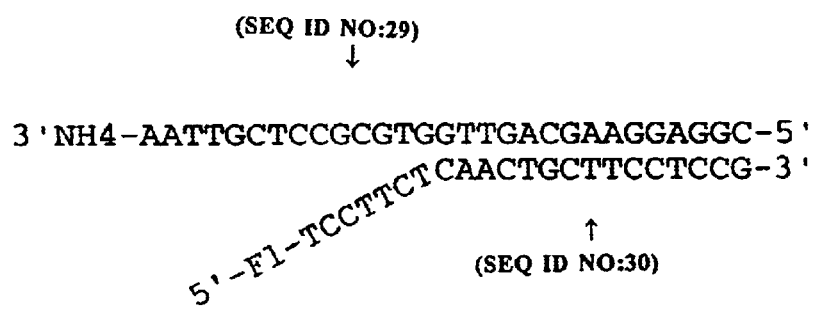
A
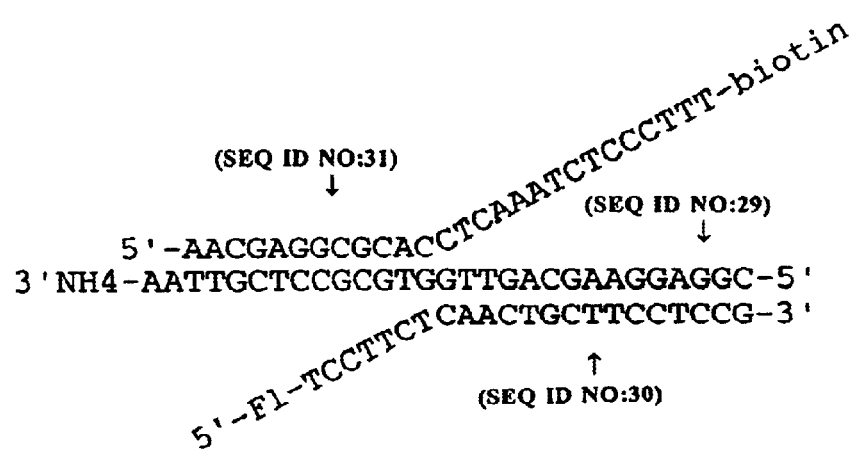
B

FIGURE 24
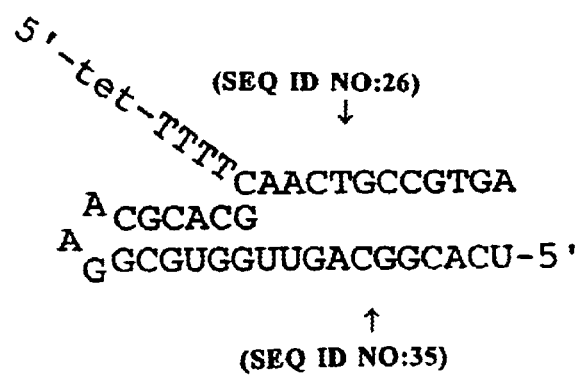
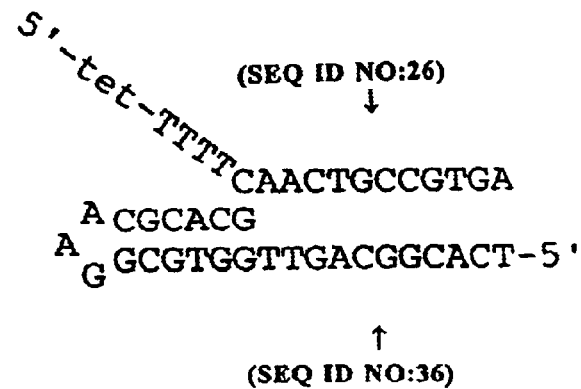

ENZYMES FOR THE DETECTION OF SPECIFIC NUCLEIC ACID SEQUENCES

This invention was made with United States Government support under Cooperative Agreement Number 70NANB7H3015, awarded by the National Institute of Standards and Technology (NIST). The United States Government has certain rights in the invention.

FIELD OF THE INVENTION

The present invention relates to novel enzymes designed for direct detection, characterization and quantitation of nucleic acids, particularly RNA. The present invention provides enzymes that recognize specific nucleic acid cleavage structures formed on a target RNA sequence and that cleave the nucleic acid cleavage structure in a site-specific manner to produce non-target cleavage products. The present invention provides enzymes having an improved ability to specifically cleave a DNA member of a complex comprising DNA and RNA nucleic acid strands.

BACKGROUND OF THE INVENTION

In molecular medicine, a simple and cost-effective method for direct and quantitative RNA detection would greatly facilitate the analysis of RNA viruses and the measurement of specific gene expression. Both of these issues are currently pressing problems in the field. Despite this need, few techniques have emerged that are truly direct. PCR-based detection assays require conversion of RNA to DNA by reverse trinscriptase before amplification, introducing a variable that can compromise accurate quantification. Furthermore, PCR and other methods based on exponential amplification (e.g., NASBA) require painstaking containment measures to avoid cross-contamination, and have difficulty distinguishing small differences (e.g., 2 to 3-fold) in quantity. Other tests that directly examine RNA suffer from a variety of drawbacks, including time consuming autoradiography steps (e.g., RNase protection assays), or overnight reaction times (e.g., branched DNA assays). With over 1.5 million viral load measurements being performed in the U.S. every year, there is clearly an enormous potential for an inexpensive, rapid, high-throughput system for the quantitative measurement of RNA.

Techniques for direct, quantitative detection of mRNA are vital for monitoring expression of a number of different genes. In particular, levels of cytokine expression (e.g., interleukins and lymphokines) are being exploited as clinical measures of immune response in the progression of a wide variety of diseases (Van Deuren et al., J. Int. Fed. Clin. Chem., 5:216 [1993], Van Deuren et al., J. Inf. Dis., 169:157 [1994], Perenboom et al., Eur. J. Clin. Invest., 26:159 [1996], Guidotti et al., Immunity 4:25 [1996]) as well as in monitoring transplant recipients (Grant et al., Transplantation 62:910 [1996]). Additionally, the monitoring of viral load and identification of viral genotype have great clinical significance for individuals suffering viral infections by such pathogens as HIV or Hepatitis C virus (HCV). There is a high correlation between viral load (i.e., the absolute number of viral particles in the bloodstream) and time to progression to AIDS (Mellors et al., Science 272:1167 [1996], Saag et al., Nature Medicine 2:625 [1996]). For that reason, viral load, as measured by quantitative nucleic acid based testing, is becoming a standard monitoring procedure for evaluating the efficacy of treatment and the clinical status of HIV positive patients. It is thought to be essential to reduce viral load as early in the course of infection as possible and to evaluate viral levels on a regular basis. In the case of HCV, viral genotype has great clinical significance, with correlations to severity of liver disease and responsiveness to interferon therapy. Furthermore, because HCV cannot be grown in culture, it is only by establishing correlations between characteristics like viral genotype and clinical outcome that new antiviral treatments can be evaluated.

While the above mentioned methods have been serviceable for low throughput, research applications, or for limited clinical application, it is clear that large scale quantitative analysis of RNA readily adaptable to any genetic system will require a more innovative approach. An ideal direct detection method would combine the advantages of the direct detection assays (e.g., easy quantification and minimal risk of carry-over contamination) with the specificity provided by a dual oligonucleotide hybridization assay.

Many of the methods described above rely on hybridization alone to distinguish a target molecule from other nucleic acids. Although some of these methods can be highly sensitive, they often cannot quantitate and distinguish closely related mRNAs accurately, especially such RNAs expressed at different levels in the same sample. While the above-mentioned methods are serviceable for some purposes, a need exists for a technology that is particularly adept at distinguishing particular RNAs from closely related molecules.

SUMMARY OF THE INVENTION

The present invention relates to novel enzymes designed for direct detection, characterization and quantitation of nucleic acids, particularly RNA. The present invention provides enzymes that recognize specific nucleic acid cleavage structures formed on a target RNA sequence and that cleave the nucleic acid cleavage structure in a site-specific manner to produce non-target cleavage products. The present invention provides enzymes having an improved ability to specifically cleave a DNA member of a complex comprising DNA and RNA nucleic acid strands.

For example, the present invention provides DNA polymerases that are altered in structure relative to the native DNA polymerases, such that they exhibit altered (e.g., improved) performance in detection assays based on the cleavage of a structure comprising nucleic acid (e.g., RNA). In particular, the altered polymerases of the present invention exhibit improved performance in detection assays based on the cleavage of a DNA member of a cleavage structure (e.g., an invasive cleavage structure) that comprises an RNA target strand.

The improved performance in a detection assay may arise from any one of, or a combination of several improved features. For example, in one embodiment, the enzyme of the present invention may have an improved rate of cleavage ($k_{cat}$) on a specific targeted structure, such that a larger amount of a cleavage product may be produced in a given time span. In another embodiment, the enzyme of the present invention may have a reduced activity or rate in the cleavage of inappropriate or non-specific structures. For example, in certain embodiments of the present invention, one aspect of improvement is that the differential between the detectable amount of cleavage of a specific structure and the detectable amount of cleavage of any alternative structures is increased. As such, it is within the scope of the present invention to provide an enzyme having a reduced rate of cleavage of a specific target structure compared to the rate of the native enzyme, and having a further reduced rate of cleavage of any alternative structures, such that the differential between the detectable amount of cleavage of the specific structure and the detectable amount of cleavage of any alternative structures is increased. However, the present invention is not limited to enzymes that have an improved differential.

In a preferred embodiment, the enzyme of the present invention is a DNA polymerase having an altered nuclease activity as described above, and also having altered synthetic activity, compared to that of any native DNA polymerase from which the enzyme has been derived. It is especially preferred that the DNA polymerase is altered such that it exhibits reduced synthetic activity as well as improved nuclease activity on RNA targets, compared to that of the native DNA polymerase. Enzymes and genes encoding enzymes having reduced synthetic activity have been described (See e.g., Kaiser et al., J. Biol. Chem., 274:21387 [1999], Lyamichev et al., Prot. Natl. Acad. Sci., 96:6143 [1999], U.S. Pat. Nos. 5,541,311, 5,614,402, 5,795,763 and U.S. patent application Ser. No. 08/758,314, incorporated herein by reference in their entireties). The present invention contemplates combined modifications, such that the resulting 5' nucleases are without interfering synthetic activity, and have improved performance in RNA detection assays.

The present invention contemplates a DNA sequence encoding a DNA polymerase altered in sequence relative to the native sequence, such that it exhibits altered nuclease activity from that of the native DNA polymerase. For example, in one embodiment, the DNA sequence encodes an enzyme having an improved rate of cleavage ($k_{cat}$) on a specific targeted structure, such that a larger amount of a cleavage product may be produced in a given time span. In another embodiment, the DNA encodes an enzyme having a reduced activity or rate in the cleavage of inappropriate or non-specific structures. In certain embodiments, one aspect of improvement is that the differential between the detectable amount of cleavage of a specific structure and the detectable amount of cleavage of any alternative structures is increased. It is within the scope of the present invention to provide a DNA encoding an enzyme having a reduced rate of cleavage of a specific target structure compared to the rate of the native enzyme, and having a further reduced rate of cleavage of any alternative structures, such that the differential between the detectable amount of cleavage of the specific structure and the detectable amount of cleavage of any alternative structures is increased. However, the present invention is not limited to polymerases that have an improved differential.

In a preferred embodiment, the DNA sequence encodes a DNA polymerase having the altered nuclease activity described above, and also having altered synthetic activity, compared to that of any native DNA polymerase from which the improved enzyme is derived. It is especially preferred that the encoded DNA polymerase is altered such that it exhibits reduced synthetic activity as well as improved nuclease activity on RNA targets, compared to that of the native DNA polymerase.

It is not intended that the invention be limited by the nature of the alteration required to introduce altered nuclease activity. Nor is it intended that the invention be limited by the extent of either the alteration, or in the improvement observed. If the polymerase is also altered so as to be synthesis modified, it is not intended that the invention be limited by the polymerase activity of the modified or unmodified protein, or by the nature of the alteration to render the polymerase synthesis modified.

The present invention contemplates structure-specific nucleases from a variety of sources, including, but not limited to, mesophilic, psychrophilic, thermophilic, and hyperthermophilic organisms. The preferred structure-specific nucleases are thermostable. Thermostable structure-specific nucleases are contemplated as particularly useful in that they allow the INVADER assay (See e.g., U.S. Pat. Nos. 5,846,717, 5,985,557, 5,994,069, and 6,001,567 and PCT Publications WO 97/27214 and WO 98/42873, incorporated herein by reference in their entireties) to be operated near the melting temperature ($T_m$) of the downstream probe oligonucleotide, so that cleaved and uncleaved probes may cycle on and off the target during the course of the reaction. In one embodiment, the thermostable structure-specific enzymes are thermostable 5' nucleases that are selected from the group comprising altered polymerases derived from the native polymerases of Thermus species, including, but not limited to, *Thermus aquaticus, Thermus flavus, Thermus thermophilus, Thermus filiformis,* and *Thermus scotoductus*. However, the invention is not limited to the use of thermostable 5' nucleases. For example, certain embodiments of the present invention utilize short oligonucleotide probes that may cycle on and off of the target at low temperatures, allowing the use of non-thermostable enzymes.

In some preferred embodiments, the present invention provides a composition comprising an enzyme, wherein the enzyme comprises a heterologous functional domain, wherein the heterologous functional domain provides altered (e.g., improved) functionality in a nucleic acid cleavage assay. The present invention is not limited by the nature of the nucleic acid cleavage assay. For example, nucleic acid cleavage assays include any assay in which a nucleic acid is cleaved, directly or indirectly, in the presence of the enzyme. In certain preferred embodiments, the nucleic acid cleavage assay is an invasive cleavage assay. In particularly preferred embodiments, the cleavage assay utilizes a cleavage structure having at least one RNA component. In another particularly preferred embodiment, the cleavage assay utilizes a cleavage structure having at least one RNA component, wherein a DNA member of the cleavage structure is cleaved.

In some preferred embodiments, the enzyme comprises a 5' nuclease or a polymerase. In certain preferred embodiments, the 5' nuclease comprises a thermostable 5' nuclease. In other preferred embodiments, the polymerase is altered in sequence relative to a naturally occuring sequence of a polymerase such that it exhibits reduced DNA synthetic activity from that of the naturally occurring polymerase. In certain preferred embodiments, the polymerase comprises a thermostable polymerase (e.g., a polymerase from a Thermus species including, but not limited to, *Thermus aquaticus, Thermus flavus, Thermus thermophilus, Thermus filiformis,* and *Thermus scotoductus*).

The present invention is not limited by the nature of the altered functionality provided by the heterologous functional domain. Illustrative examples of alterations include, but are not limited to, enzymes where the heterologous functional domain comprises an amino acid sequence (e.g., one or more amino acids) that provides an improved nuclease activity, an improved substrate binding activity and/or improved background specificity in a nucleic acid cleavage assay.

The present invention is not limited by the nature of the heterologous functional domain. For example, in some embodiments, the heterologous functional domain comprises two or more amino acids from a polymerase domain of a polymerase (e.g., introduced into the enzyme by insertion of a chimeric functional domain or created by mutation). In certain preferred embodiment, at least one of the two or more amino acids is from a palm or thumb region of the polymerase domain. The present invention is not limited by the identity of the polymerase from which the two or more amino acids are selected. In certain preferred embodiments, the polymerase comprises *Thermus thermophilus* polymerase. In particularly preferred embodiments, the two or more amino acids are from amino acids 300–650 of SEQ ID NO:267.

The novel enzymes of the invention may be employed for the detection of target DNAs and RNAs including, but not limited to, target DNAs and RNAs comprising wild type and mutant alleles of genes, including, but not limited to, genes from humans, other animal, or plants that are or may be associated with disease or other conditions. In addition, the enzymes of the invention may be used for the detection of and/or identification of strains of microorganisms, including bacteria, fungi, protozoa, ciliates and viruses (and in particular for the detection and identification of viruses having RNA genomes, such as the Hepatitis C and Human Immunodeficiency viruses). For example, the present invention provides methods for cleaving a nucleic acid comprising providing: an enzyme of the present invention and a substrate nucleic acid; and exposing the substrate nucleic acid to the enzyme (e.g., to produce a cleavage product that may be detected).

In one embodiment, the present invention provides a thermostable 5' nuclease having an amino acid sequence selected from the group comprising SEQ ID NOS:75, 77, 79, 81, 83, 85, 87, 89, 91, 93, 95, 97, 99, 101, 103, 106, 109, 112, 115, 118, 121, 124, 127, 130, 133, 136, 139, 142, 145, 148, 150, 153, 157, 160, 163, 166, 169, 172, 175, 178, 181, 184, 187, 190, 200, 202, 204, 206, 212, 214, 216, 218, 221, 226, 228, 230, 232, 234, 236, 239, 241, 243, 251, 259, 261, 263, and 265. In another embodiment, the 5' nuclease is encoded by a DNA sequence selected from the group comprising of SEQ ID NOS:74, 76, 78, 80, 82, 84, 86, 88, 90, 92, 94, 96, 98, 100, 102, 105, 108, 111, 114, 117, 120, 123, 126, 129, 132, 135, 138, 141, 144, 147, 149, 152, 156, 159, 162, 165, 168, 171, 174, 177, 180, 183, 186, 189, 199, 201, 203, 205, 211, 213, 215, 217, 220, 225, 227, 229, 231, 233, 235, 238, 240, 242, 250, 258, 260, 262, and 264.

The present invention also provides a recombinant DNA vector comprising DNA having a nucleotide sequence encoding a 5' nuclease, the nucleotide sequence selected from the group comprising SEQ ID NOS:74, 76, 78, 80, 82, 84, 86, 88, 90, 92, 94, 96, 98, 100, 102, 105, 108, 111, 114, 117, 120, 123, 126, 129, 132, 135, 138, 141, 144, 147, 149, 152, 156, 159, 162, 165, 168, 171, 174, 177, 180, 183, 186, 189, 199, 201, 203, 205, 211, 213, 215, 217, 220, 225, 227, 229, 231, 233, 235, 238, 240, 242, 250, 258, 260, 262, and 264. In a preferred embodiment, the invention provides a host cell transformed with a recombinant DNA vector comprising DNA having a nucleotide sequence encoding a structure-specific nuclease, the nucleotide selected from the group comprising sequence SEQ ID NOS:74, 76, 78, 80, 82, 84, 86, 88, 90, 92, 94, 96, 98, 100, 102, 105, 108, 111, 114, 117, 120, 123, 126, 129, 132, 135, 138, 141, 144, 147, 149, 152, 156, 159, 162, 165, 168, 171, 174, 177, 180, 183, 186, 189, 199, 201, 203, 205, 211, 213, 215, 217, 220, 225, 227, 229, 231, 233, 235, 238, 240, 242, 250, 258, 260, 262, and 264. The invention is not limited by the nature of the host cell employed. The art is well aware of expression vectors suitable for the expression of nucleotide sequences encoding structure-specific nucleases that can be expressed in a variety of prokaryotic and eukaryotic host cells. In a preferred embodiment, the host cell is an *Escherichia coli* cell.

The present invention provides a method of altering 5' nuclease enzymes relative to native 5' nuclease enzymes, such that they exhibit improved performance in detection assays based on the cleavage of a structure comprising RNA. In particular, the altered 5' nucleases produced by the method of the present invention exhibit improved performance in detection assays based on the cleavage of a DNA member of a cleavage structure (e.g., an invasive cleavage structure) that comprises an RNA target strand. The improved 5' nucleases resulting from the methods of the present invention may be improved in any of the ways discussed herein. Examples of processes for assessing improvement in any candidate enzyme are provided.

For example, the present invention provides methods for producing an altered enzyme with improved functionality in a nucleic acid cleavage assay comprising: providing an enzyme and a nucleic acid test substrate; introducing a heterologous functional domain into the enzyme to produce an altered enzyme; contacting the altered enzyme with the nucleic acid test substrate to produce cleavage products; and detecting the cleavage products. In some embodiments, the introduction of the heterologous functional domain comprises mutating one or more amino acids of the enzyme. In other embodiments, the introduction of the heterologous functional domain into the enzyme comprises adding a functional domain from a protein (e.g., another enzyme) into the enzyme (e.g., substituting functional domains by removing a portion of the enzyme sequence prior to adding the functional domain of the protein). In preferred embodiments, the nucleic acid test substrate comprises a cleavage structure. In particularly preferred embodiment, the cleavage structure comprises an RNA target nucleic acid. In yet other preferred embodiments, the cleavage structure comprises an invasive cleavage structure.

The present invention also provides nucleic acid treatment kits. One preferred embodiment is a kit comprising a composition comprising at least one improved 5' nuclease. Another preferred embodiment provides a kit comprising: a) a composition comprising at least one improved 5' nuclease; and b) an INVADER oligonucleotide and a signal probe oligonucleotide. In some embodiments of the kits of the present invention, the improved 5' nuclease is derived from a DNA polymerase from a eubacterial species. In further embodiments, the eubacterial species is a thermophile. In still further embodiments, the thermophile is of the genus Thermus. In still further embodiments, the thermophile is selected from the group consisting of *Thermus aquaticus, Thermus flavus, Thermus thermophilus, Thermus filiformis,* and *Thermus scotoductus*. In preferred embodiments, the improved 5' nuclease is encoded by DNA selected from the group comprising SEQ ID NOS:74, 76, 78, 80, 82, 84, 86, 88, 90, 92, 94, 96, 98, 100, 102, 105, 108, 111, 114, 117, 120, 123, 126, 129, 132, 135, 138, 141, 144, 147, 149, 152, 156, 159, 162, 165, 168, 171, 174, 177, 180, 183, 186, 189, 199, 201, 203, 205, 211, 213, 215, 217, 220, 225, 227, 229, 231, 233, 235, 238, 240, 242, 250, 258, 260, 262, and 264. In yet other preferred embodiments, the kits further comprise reagents for detecting a nucleic acid cleavage product. In further preferred embodiments, the reagents for detecting a cleavage product comprise oligonucleotides for use in a subsequent invasive cleavage reaction (See e.g., U.S. Pat. No. 5,994,069). In particularly preferred embodiments, the reagents for the subsequent invasive cleavage reaction comprise a probe labeled with moieties that produce a fluorescence resonance energy transfer (FRET) effect.

DESCRIPTION OF THE DRAWINGS

FIGS. 8A–8H are a comparison of the nucleotide structure of the polymerase genes isolated from Thermus aquaticus (SEQ ID NO:1), Thermus flavus (SEQ ID NO:2) and Thermus thermophilus (SEQ ID NO:266); the consensus sequence (SEQ ID NO:7) is shown at the top of each row.

FIGS. 9A–9C are a comparison of the amino acid sequence of the polymerase isolated from Thermus aquaticus (SEQ ID NO:4), Thermus flavus (SEQ ID NO:5), and Thermus thermophilus (SEQ ID NO:267); the consensus sequence (SEQ ID NO:8) is shown at the top of each row.

FIG. 11 shows the image generated by a fluorescence imager showing the products of invasive cleavage assays using the indicated enzymes, and the IL-6 substrate of FIG. 10 having either a DNA target strand (A) or an RNA target strand (B).

FIG. 13 shows a comparison of the amino acid sequences of the BstI-BamHI fragments of TaqPol (SEQ ID NO:19) and TthPol (SEQ ID NO:20). Pairs of similar amino acids are shaded with light gray. Aligned amino acids that have a charge difference are shaded with dark gray. The numbers correspond to the amino acid sequence of TaqPol. Amino acids of TaqPol changed to the corresponding amino acids of TthPol by site-directed mutagenesis are indicated by (+).

FIG. 16 compares polymerization activities of TaqPol, TthPol, and Taq-Tth chimerical enzymes, and TaqPol having the indicated amino acid modifications.

FIG. 21 shows schematic diagrams for model substrates used to test enzymes for invasive cleavage activity. The molecule shown in 21A provides a DNA target strand (SEQ ID NO:28), while the model shown in 21B provides an RNA containing target strand (SEQ ID NO:27). Both 21A and B show downstream probe SEQ ID NO:26.

FIGS. 22A–22B show schematic diagrams for model substrates used to test enzymes for cleavage activity on alternative, non-invasive structures.

FIGS. 24A–24B show schematic diagrams for a model substrate used to test enzymes for invasive cleavage activity on an RNA or DNA target strands.

GENERAL DESCRIPTION OF THE INVENTION

The INVADER technology (See e.g., U.S. Pat. Nos. 5,846,717, 5,985,557, 5,994,069, and 6,001,567 and PCT Publications WO 97/27214 and WO 98/42873, incorporated herein by reference in their entireties) provides a signal amplification system that can be applied to the detection and quantitation of specific nucleic acid sequences, including single point mutations and similar variants of mRNA. Further, because this technology does not rely exclusively on allele-specific hybridization, it is well suited for quantitating closely related RNAs in the same sample. The present invention provides improved enzymes and methods for creating enzymes for the INVADER assay-based detection of nucleic acids, particularly RNA nucleic acids. The present invention also provides kits for the performance of INVADER assays using the improved enzymes of the present invention.

Figure 1:
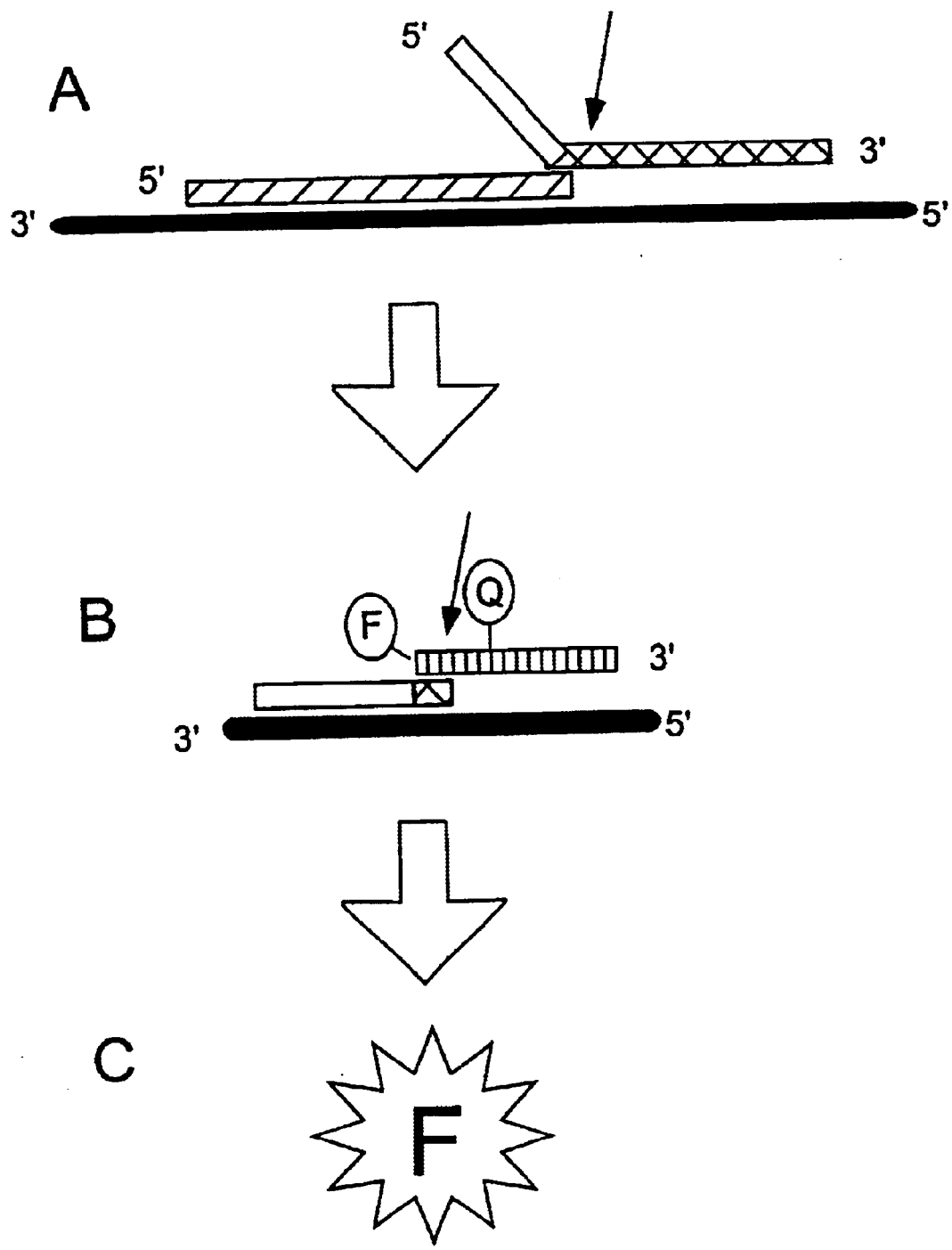
FIG. 1 shows a schematic representation of sequential invasive cleavage reactions. In step A, an upstream INVADER oligonucleotide and a downstream probe combine with a target nucleic acid strand to form a cleavage structure. In step B, the portion of the cleaved signal probe from A combines with a second target nucleic acid strand and a labeled signal probe to form a second cleavage structure. In step C, cleavage of the labeled second cleavage structure yields a detectable signal.
Figure 2:
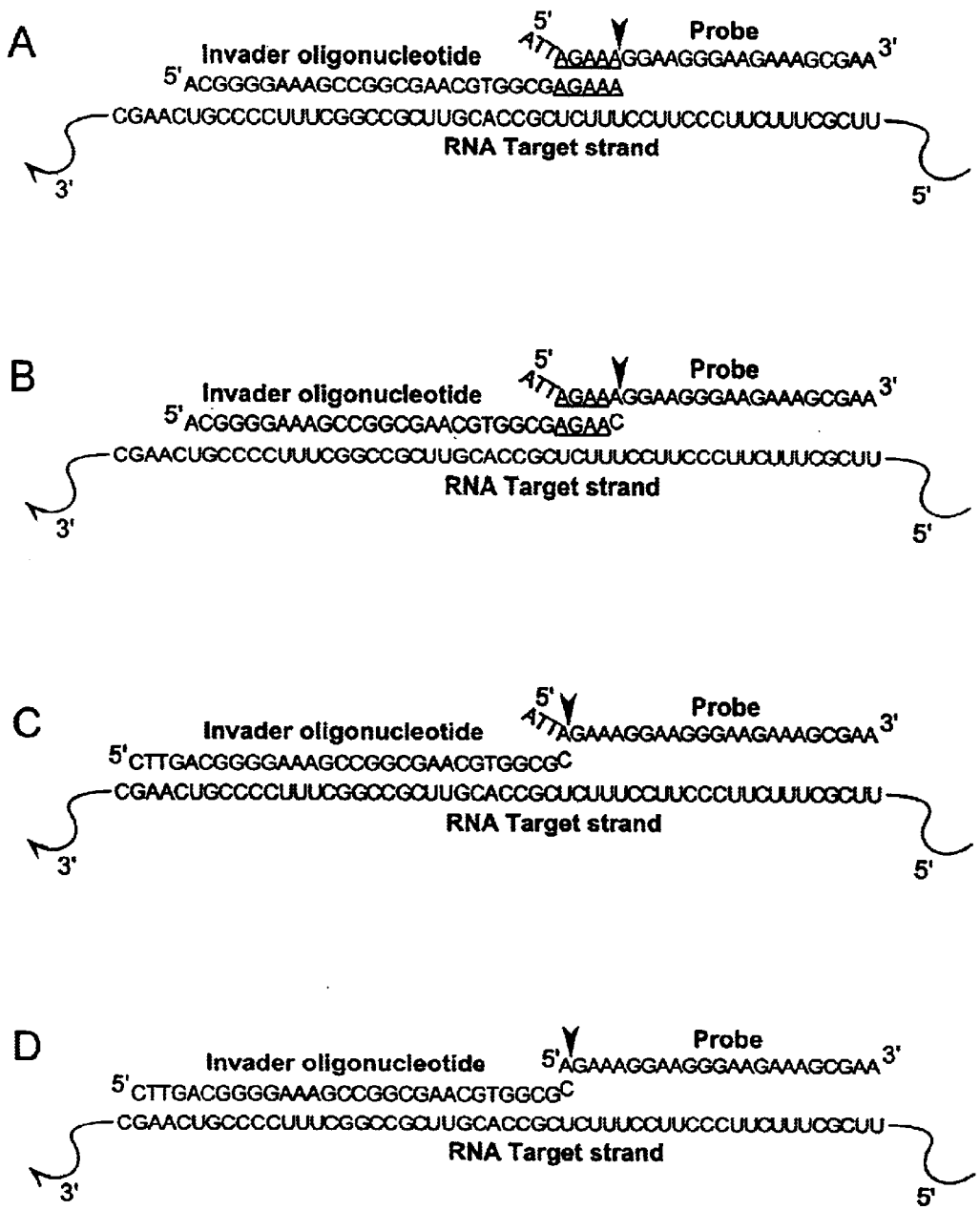
FIG. 2 shows schematic representations of several examples of invasive cleavage structures comprising RNA target strands (SEQ ID NO:9). Panel A depicts an INVADER oligonucleotide (SEQ ID NO:10) and probe (SEQ ID NO:11). Panel B depicts an INVADER oligonucleotide (SEQ ID NO:12) and probe (SEQ ID NO:11). Panel C depicts an INVADER oligonucleotide (SEQ ID NO:13) and probe (SEQ ID NO:13). Panel D depicts an INVADER oligonucleotide (SEQ ID NO:13) and probe (SEQ ID NO:14).
Figure 3:
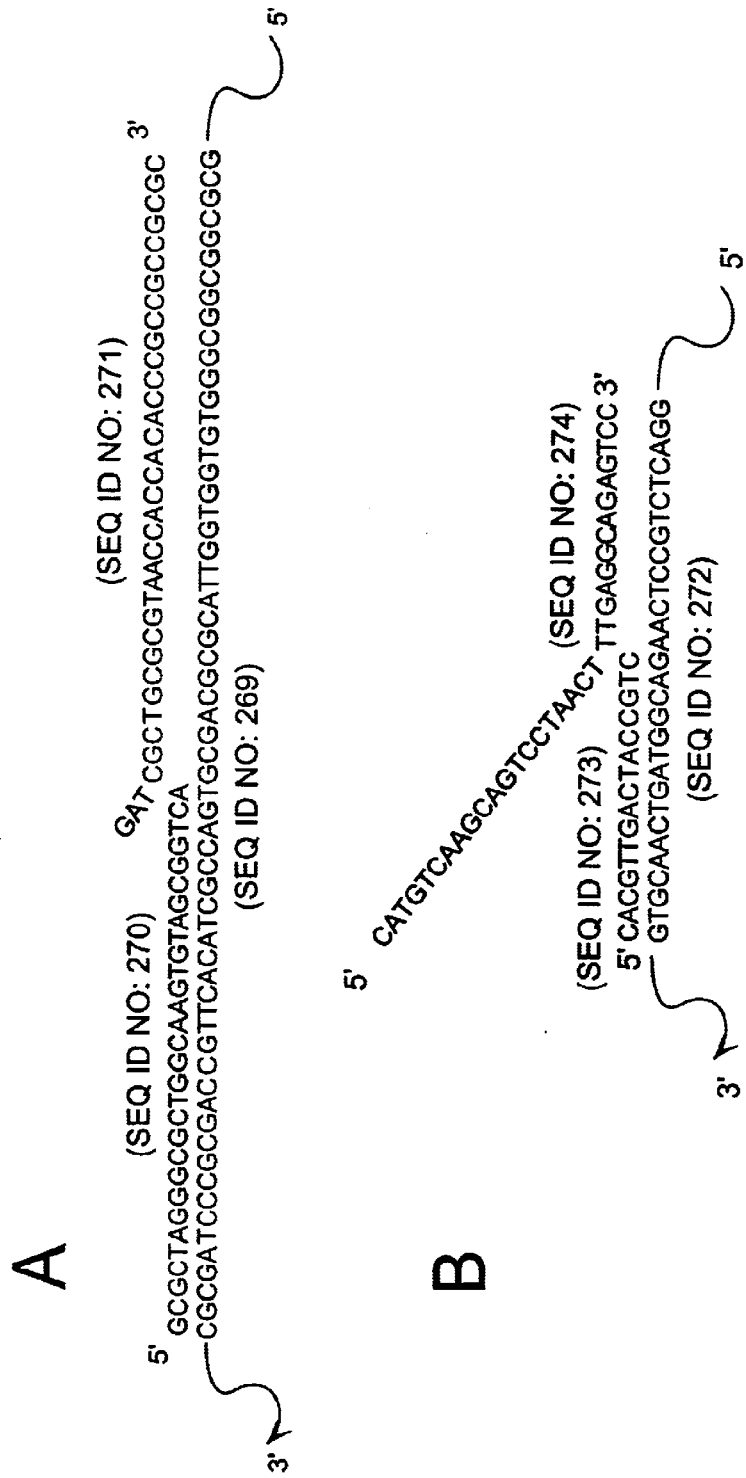
FIG. 3 shows schematic representations of two examples of structures that are not invasive cleavage structures labelled SEQ ID NOs:269–274.

The INVADER technology was developed for quantitative detection of DNA and RNA, without prior amplification of the target nucleic acid (Lyamichev et al., Nat. Biotechnol., 17:292 [1999]). In addition to its use for the quantitative measurement of specific nucleic acid sequences, high specificity provides the capability of detecting single base changes. The basis of the INVADER technology is the cleavage of DNA and RNA molecules at specific locations in response to structure rather than sequence. Cleavage is typically catalyzed by a 5' nuclease enzyme. The 5' nuclease enzymes recognize a precise structure that is formed when two oligonucleotide probes, an upstream INVADER probe and a downstream signal probe, hybridize in tandem to a nucleic acid target to generate the substrate complex (FIG. 1A). The high specificity of the INVADER technology arises from combining sequence-specific probe hybridization with structure specific enzymatic cleavage. The substrate complex contains a feature that is important for precise enzyme recognition: an overlap between the hybridized oligonucleotides. To form an invasive structure, the 3' end of the upstream INVADER oligonucleotide must overlap with the hybridized region of the signal probe by at least one base (Lyamichev et al., Nat. Biotechnol., 17:292 [1999]). This overlap may be created by a duplication of sequence between the 3' portion of the upstream INVADER oligonucleotide and the 5' portion of the target-complementary region of the downstream probe oligonucleotide. The region of sequence so duplicated may be as small as a single base. Regardless of the length of the duplicated sequence (ie., the overlap) the 3' terminal base of the upstream INVADER oligonucleotide need not be complementary to the target strand, and may be any nucleotide. In some embodiments, this terminal nucleotide may be replaced by a moiety having chemical features similar to a nucleotide such as a nucleotide analog or an organic ring compound (See e.g., U.S. Pat. No. 5,985,557). In an alternative embodiment, the overlap need not involve any duplication of sequence between the target-complementary regions of the two probes (Lyamichev et al., Nat. Biotechnol., 17:292 [1999] and U.S. Pat. No. 5,985,557). In this embodiment, the INVADER and signal probes have regions complementary to adjacent regions of the target that are contiguous and that do not overlap. When no sequence is shared, the 3' end of the upstream INVADER oligonucleotide includes at least one additional nucleotide or nucleotide-like analog that is not complementary to the target strand (Lyamichev et al., Nat. Biotechnol., 17:292 [1999]). This can be referred to as a physical overlap, in contrast to a sequence overlap. An overlap of either type will satisfy the requirement for overlap that is the hallmark of the invasive cleavage of the INVADER assay. Several of these embodiments are shown schematically in FIG. 2. In contrast to the overlap configurations described above, if the probes have regions complementary to adjacent regions of the target that are contiguous and that do not overlap, and the 3' end of the upstream oligonucleotide does not have any additional base or moiety, the invasive structure is not formed (FIG. 3A). Even the presence of one or more additional bases on the 5' end of the downstream oligonucleotide that are not complementary to the target strand will not create the requisite overlap. This latter structure (FIG. 3B), as is described in U.S. Pat. No. 5,874,283 is not an "invasive cleavage," although such structures find use in certain embodiments of the present invention.

Some 5' nucleases may not require an upstream oligonucleotide to be active in a cleavage reaction. Although cleavage may be slower without the upstream oligonucleotide, it may still occur (Lyamichev et al., Science 260:778 [1993], Kaiser et al., J. Biol. Chem., 274:21387 [1999]). When a DNA strand is the template or target strand to which probe oligonucleotides are hybridized, the 5' nucleases derived from DNA polymerases and some flap endonucleases (FENs), such as that from *Methanococcus jannaschii*, can cleave quite well without an upstream oligonucleotide providing an overlap (Lyamichev et al., Science 260:778 [1993], Kaiser et al., J. Biol. Chem., 274:21387 [1999], and U.S. Pat. No. 5,843,669, herein incorporated by reference in its entirety). Other FENs, such as those from *Archeaoglobus fulgidus* (AfA) and *Pyrococcus furiosus* (Pfu), cleave an overlapped structure on a DNA target at so much greater a rate than they do a non-overlapping structure (i.e., either missing the upstream oligonucleotide or having a non-overlapping upstream oligonucleotide) that they can be viewed as having an essentially absolute requirement for the overlap (Lyamichev et al., Nat. Biotechnol., 17:292 [1999], Kaiser et al., J. Biol. Chem., 274:21387 [1999]). When an RNA target is hybridized to DNA oligonucleotide probes to form a cleavage structure, many FENs cleave the downstream DNA probe poorly, regardless of the presence of an overlap. On such an RNA-containing structure, the 5' nucleases derived from DNA polymerases have a strong requirement for the overlap, and are essentially inactive in its absence.

Figure 4:
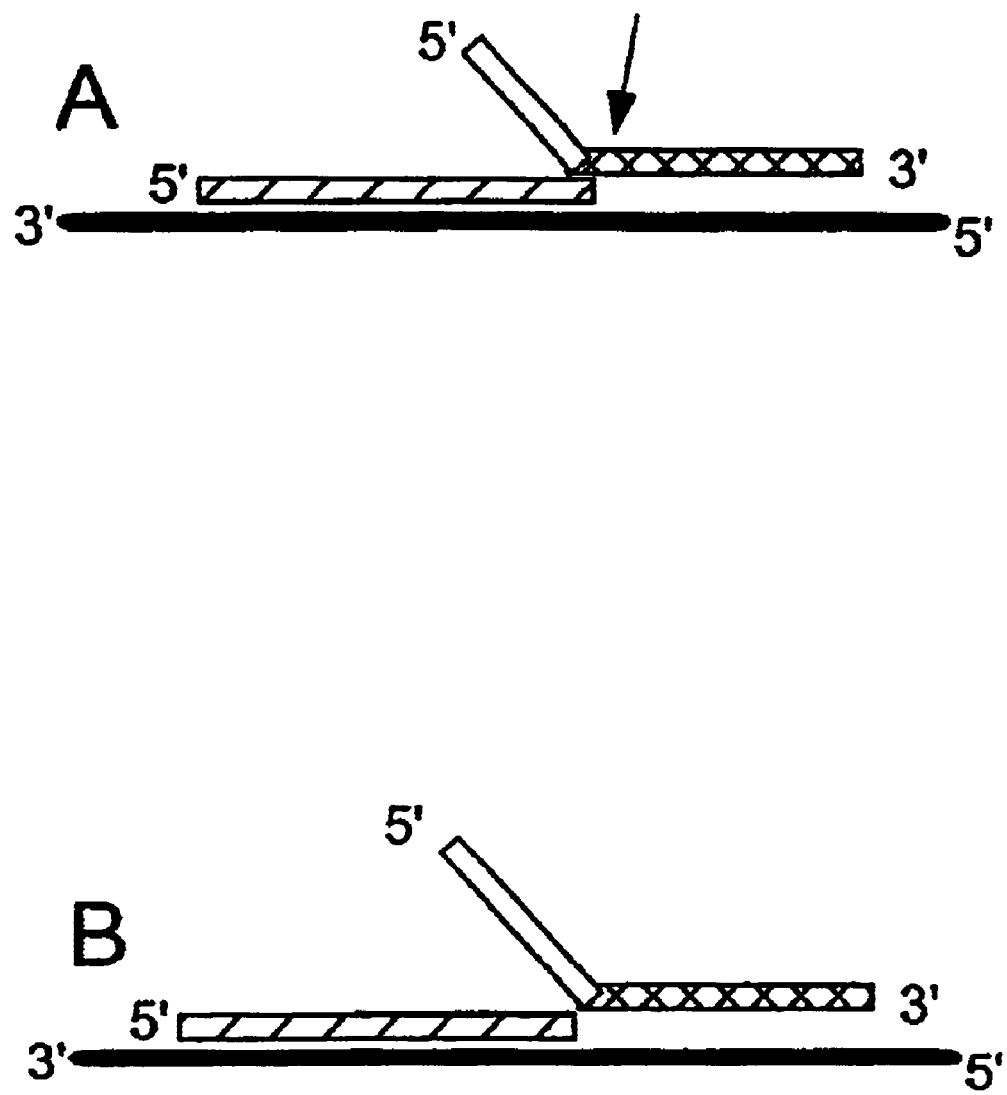
FIG. 4 shows a schematic representation of a configuration of invasive cleavage that is useful for detection of target sequence variations. In A, an invasive cleavage structure having overlap between the two probes is formed, and the arrow indicates that it is cleavable by the enzymes of the present invention. In B, variation of the target sequence removes a region of complementarity to the downstream probe and eliminates the overlap. The absence of an arrow in panel B indicates a reduced rate of cleavage of this structure compared to that diagrammed in panel A.

Performing the INVADER assay under conditions that have a tight requirement for an overlap (e.g., using the Afu FEN for DNA target detection or the 5' nuclease of Tth DNA polymerase for RNA target detection) provides a superior means of detecting single nucleotide or other sequence variations. In one embodiment, the signal probe is selected such that the target base suspected of varying is positioned at the 5' end of the target-complimentary region of this probe. The upstream INVADER oligonucleotide is positioned to provide a single base of overlap. If the target and the signal probe are complementary at the base in question, the overlap forms and cleavage can occur. This embodiment is diagrammed in FIG. 4A. However, if the target does not complement the probe at this position, that base in the probe becomes part of a non-complementary 5' arm, no overlap between the probes exists, and cleavage is suppressed. This embodiment is diagrammed in FIG. 4B. In any of the aforementioned embodiments, the downstream probe may optionally include a region that is not complementary to the target. In a preferred embodiment, this non target-complementary region is on the 5' end of the probe and produces an unpaired 5' flap when the signal probe is hybridized to the target. Upon cleavage by a CLEAVASE enzyme, a released 5' flap can be incorporated into a subsequent INVADER reaction for further amplification of the signal (See e.g., U.S. Pat. No. 5,994,069 and PCT Publication WO 98/42873, incorporated herein by reference in their entireties). One way it may be used is as an INVADER oligonucleotide, which may combine with a provided secondary target and a secondary probe. Upon a hybridization of the 5' flap released by the CLEAVASE enzyme in the first invasive cleavage reaction, a secondary invasive structure complex is completed, so that it may be recognized by the CLEAVASE enzyme and the secondary probe oligonucleotide may be cleaved (Kwiatkowski et al., Molec. Diagn., 4:353 [1999]), FIG. 1.

INVADER assays often use thermostable CLEAVASE enzymes, allowing reactions to be operated near the melting temperature ($T_m$) of the downstream probe oligonucleotide, so that cleaved and uncleaved probes cycle on and off the target during the course of the reaction. In a preferred embodiment, a longer INVADER oligonucleotide may not readily cycle. Each time a full-length probe binds to the target in the presence of the INVADER oligonucleotide it can be cleaved, resulting in an accumulation of cleavage product that is both highly specific for the sequence being detected, and that is generally proportional with respect to both time and target concentration. The target is generally the limiting component in an invasive cleavage, since the INVADER and signal probe oligonucleotides are generally supplied in molar excess. In a second linked invasive cleavage, it is the component created in the first cleavage reaction (e.g., a released 5' flap) that is limiting. When two such cleavage reactions are performed sequentially, the signal from the composite reaction accumulates linearly with respect to the amount of target nucleic acid while the reaction sequence results in a tremendous increase in signal amplification (Kwiatkowski et al., Molec. Diagn., 4:353 [1999]).

Several of the 5' nuclease domains of eubacterial Pol A DNA polymerases and structurally homologous DNA repair proteins, called flap endonucleases (FENs) can function to cleave the secondary structure formed between the INVADER and signal probe oligonucleotides (Kaiser et al., J. Biol. Chem., 274:21387 [1999], Xu et al., J. Biol. Chem, published online as 10.1074/jbc.M909135199 at wwwjbc.org/pips/pips.2.shtml, May 9, 2000). Both classes of enzymes contain a putative helix-hairpin-helix (HhH) DNA binding motif important for sequence independent, structure-based recognition of DNA (Doherty et al., Nucl. Acid. Res., 24:2488 [1996]). This type of DNA binding motif is suitable for assays performed on DNA targets, but can be problematic for assays with RNA targets, resulting in lower assay sensitivity. New enzymes having improved recognition of the invasive cleavage structure formed on an RNA target strand would vastly improve the performance of the INVADER assay in the detection and quantitation of RNA targets.

A number of enzyme improvements related to 5' nucleases and DNA polymerases have been described. For example, DNA polymerases having altered 5' nuclease activity, or lacking 5' nuclease activity altogether have been described (U.S. Pat. Nos. 5,466,591 and 5,795,762, each of which is incorporated herein by reference in its entirety). These patents relate to thermostable DNA polymerases that exhibit a different level of 5' to 3' exonuclease activity than their respective native polymerases. In some embodiments, particular conserved amino acid domains in thermostable DNA polymerases are mutated or deleted to alter the 5' to 3' exonuclease activity of the polymerases.

DNA polymerases altered relative to the native polymerases such that they exhibit altered DNA synthetic activity have been described (Kaiser et al., J. Biol. Chem., 274:21387 [1999], Lyamichev et al., Proc. Natl. Acad. Sci., 96:6143 [1999], U.S. Pat. Nos. 5,541,311, 5,614,402, 5,795, 763 and U.S. patent application Ser. No. 08/58,314, incorporated herein by reference in their entireties). In preferred embodiments, these DNA polymerases are altered such that they exhibit reduced synthetic activity compared to that of the native DNA polymerase. In this respect, enzymes have been created that are predominantly 5' nucleases and are capable of cleaving nucleic acids in a structure-specific manner in the absence of interfering synthetic activity. The alterations made in these polymerases were not selected with respect to their effect of the cleavage of structures comprising RNA.

DNA polymerases having the ability to use RNA as a template strand, known as reverse transcriptases, are usually associated with an RNase activity that specifically cleaves RNA basepaired in a heteroduplex with a DNA strand. Such RNase activity is generally termed RNase H. Altered reverse transcriptases that have this RNase H activity removed have been described (See e.g., U.S. Pat. No. 5,244,797, incorporated herein by reference in its entirety). This patent relates to a gene that encodes reverse transcriptase having DNA polymerase activity and little or no RNase H activity. The invention also relates to a method of producing cDNA from mRNA using the reverse transcriptase. This patent does not describe enzymes having improved ability to cleave a DNA member of a structure comprising DNA and RNA strands, nor does it relate to enzymes having improved performance in detection assays based on the cleavage of a DNA member of a structure that comprises an RNA target strand.

Thermostable RNase H enzymes have been described (e.g., U.S. Pat. Nos. 5,268,289, 5,459,055 and 5,500,370, incorporated herein by reference in their entireties). These thermostable enzymes cleave the RNA member of a heteroduplex comprising DNA and RNA strands. These patents do not describe enzymes having improved ability to cleave a DNA member of a structure comprising DNA and RNA strands, nor do they relate to enzymes having improved performance in detection assays based on the cleavage of a DNA member of an invasive structure that comprises an RNA target strand.

There remains a need for enzymes having an improved ability to cleave DNA members of structures comprising RNA and DNA strands. In particular, there remains a need for thermostable enzymes having improved performance in detection assays based on the cleavage of DNA members of invasive complexes comprising an RNA target strand.

Definitions

To facilitate an understanding of the present invention, a number of terms and phrases are defined below:

As used herein, the term "functional domain" refers to a region, or a part of a region, of a protein (e.g., an enzyme) that provides one or more functional characteristic of the protein. For example, a functional domain of an enzyme may provide, directly or indirectly, one or more activities of the enzyme including, but not limited to, substrate binding capability and catalytic activity. A functional domain may be characterized through mutation of one or more amino acids within the functional domain, wherein mutation of the amino acid(s) alters the associated functionality (as measured empirically in an assay) thereby indicating the presence of a functional domain.

As used herein, the term "heterologous functional domain" refers to a protein functional domain that is not in its natural environment. For example, a heterologous functional domain includes a functional domain from one enzyme introduced into another enzyme. A heterologous functional domain also includes a functional domain native to an protein that has been altered in some way (e.g., mutated, added in multiple copies, etc.). A heterologous functional domain may comprise a plurality of contiguous amino acids or may include two or more distal amino acids are amino acids fragments (e.g., two or more amino acids or fragments with intervening, non-heterologous, sequence). Heterologous functional domains are distinguished from endogenous functional domains in that the heterologous amino acid(s) are joined to amino acid sequences that are not found naturally associated with the amino acid sequence in nature or are associated with a portion of a protein not found in nature.

As used herein, the term "altered functionality in a nucleic acid cleavage assay" refers to a characteristic of an enzyme that has been altered in some manner to differ from its natural state (e.g., to differ from how it is found in nature). Alterations include, but are not limited to, addition of a heterologous functional domain (e.g., through mutation or through creation of chimeric proteins). In some embodiments, the altered characteristic of the enzyme may be one that improves the performance of an enzyme in a nucleic acid cleavage assay. Types of improvement include, but are not limited to, improved nuclease activity (e.g., improved rate of reaction), improved substrate binding (e.g., increased or decreased binding of certain nucleic acid species [e.g., RNA or DNA] that produces a desired outcome [e.g., greater specificity, improved substrate turnover, etc.]), and improved background specificity (e.g., less undesired product is produced). The present invention is not limited by the nucleic cleavage assay used to test improved functionality. However, in some preferred embodiments of the present invention, an invasive cleavage assay is used as the nucleic acid cleavage assay. In certain particularly preferred embodiments, an invasive cleavage assay utilizing an RNA target is used as the nucleic acid cleavage assay.

The terms "signal oligonucleotide" and "signal probe" are used interchangeably, and refer to a member of a cleavage structure that is cleaved by a cleavage agent. In an "invasive cleavage structure," the signal probe may be referred to as the "downstream probe" in a complex in that, with the exception of its overlapping portion, it is largely 3' of an INVADER oligonucleotide within the complex. On the target strand, the hybridization site of a signal probe is said to be upstream of the hybridization site of an INVADER oligonucleotide.

The terms "INVADER" oligonucleotide or probe and "invasive" oligonucleotide or probe may be used interchangeably, and refer to a member of an invasive cleavage structure that hybridizes to a target nucleic acid strand and that overlaps the 5' end of a signal probe. In an invasive cleavage structure, the INVADER oligonucleotide may be referred to as the upstream oligonucleotide or probe in the complex in that, with the exception of its overlapping portion, it is largely 5' of a signal probe within the complex. On the target strand, the hybridization site of an INVADER oligonucleotide is downstream of the hybridization site of a signal probe.

The term "invasive cleavage structure" refers to a cleavage structure formed by the hybridization of two probes to a target nucleic acid, wherein the upstream probe overlaps the downstream probe by at least one base.

The term "DNA polymerase" as used herein refers to a protein that is encoded by a gene that is derived from the gene for a naturally occurring enzyme, said naturally occurring enzyme having nucleic acid synthetic activity. In some embodiments, the gene for the DNA polymerase is altered relative to the gene for the naturally occurring enzyme, such that the DNA polymerase lacks or has reduced synthetic activity.

The term "synthetic activity" refers to the ability of an enzyme to catalyze DNA synthesis by addition of deoxyribonucleotide or deoxyribonucletide analog units to a DNA chain using DNA or RNA as a template.

The term "target-complementary" refers to feature of a nucleic acid or a portion of an nucleic acid, said feature being that it is complementary to a target nucleic acid.

The terms "RNA-dependent" and "DNA-dependent", when used with reference to an enzymatic activity, refer to activity that occurs in response to the presence of an RNA or DNA target strand, respectively. A single enzyme may possess both types of activities and the presence of one type of activity does not imply the absence of any other activity. For example, description of an enzyme as having RNA-dependent 5' nuclease activity is not meant to indicate the absence of a DNA-dependent 5' nuclease activity, or any other activity. Similarly, an enzyme having a DNA-dependent activity may also have RNA-dependent and other activities.

The terms "target" and "template" are used interchangeably, and refer to a nucleic acid to be detected or analyzed. In some embodiments, the target is a nucleic acid to which one or more oligonucleotides or probes are hybridized. In a cleavage embodiment, one or more oligonucleotides may hybridize to form a cleavage structure, the formation of which may be used for detection or analysis of said target nucleic acid. The target nucleic acids include but are not limited to, single and double stranded DNA or RNA, modified nucleic acids (e.g., methylated nucleic acids), chimeric nucleic acids, peptide nucleic acids and the like. "Nucleic acid molecule" refers to any nucleic acid containing molecule. The term encompasses sequences that include base analogs of DNA and RNA including, but not limited to, 4-acetylcytosine, 8-hydroxy-N6-methyladenosine, aziridinylcytosine, pseudoisocytosine, 5-(carboxyhydroxylmethyl)uracil, 5-fluorouracil, 5-bromouracil, 5-carboxymethylaminomethyl-2-thiouracil, 5-carboxymethylaminomethyluracil, dihydrouracil, inosine, N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, 5-methylcytosine, N6-methyladenine, 7-methylguanine, 5-methylaninomethyluracil, 5-methoxyaminomethyl-2-thiouracil, beta-D-mannosylqueosine, 5'-methoxycarbonylmethyluracil, 5-methoxyuracil, 2-methylthio-N6-isopentenyladenine, uracil-5-oxyacetic acid methylester, uracil-5-oxyacetic acid, oxybutoxosine, pseudouracil, queosine, 2-thiocytosine, 5-methyl-2-thiouracil, 2-thiouracil, 4-thiouracil, 5-methyluracil, N-uracil-5-oxyacetic acid methylester, uracil-5-oxyacetic acid, pseudouracil, queosine, 2-thiocytosine, and 2,6-diaminopurine.

The term "overlap" as used herein in reference to cleavage structures, refers to a feature of an invasive cleavage structure, said feature being that the 3' end of an upstream INVADER oligonucleotide overlaps with the hybridized region of the signal probe by at least one base. An overlap may be created by a duplication of sequence between the 3' portion of the upstream INVADER oligonucleotide and the 5' portion of the target-complementary region of the downstream probe oligonucleotide. The region of sequence so duplicated may be as small as a single base. Regardless of the length of the duplicated sequence (i.e., the overlap) the 3' terminal base of the upstream INVADER oligonucleotide need not be complementary to the target strand, and may be any nucleotide. In some embodiments, this terminal nucleotide may be replaced by a moiety having chemical features similar to a nucleotide such as a nucleotide analog or an aromatic ring compound. Indeed, any chemical moiety that provides an overlap and promotes efficient invasive cleavage is contemplated. In an alternative embodiment, the overlap need not involve any duplication of sequence between the target-complementary regions of the two probes (Lyamichev et al., Nat. Biotechnol., 17:292 [1999], U.S. Pat. No. 5,985, 557). In this embodiment, the INVADER and signal probes have regions complementary to adjacent regions of the target that are contiguous and that do not overlap. When no sequence is shared, the 3' end of the upstream INVADER oligonucleotide includes at least one additional nucleotide or nucleotide-like analog that is not complementary to the target strand. This can be referred to as a physical overlap, in contrast to a sequence overlap. An overlap of either type will satisfy the requirement for overlap of the invasive cleavage of the INVADER assay.

As used herein, the terms "N-terminal" and "C-terminal" in reference to polypeptide sequences refer to regions of polypeptides including portions of the N-terminal and C-terminal regions of the polypeptide, respectively. A sequence that includes a portion of the N-terminal region of polypeptide includes amino acids predominantly from the N-terminal half of the polypeptide chain, but is not limited to such sequences. For example, an N-terminal sequence may include an interior portion of the polypeptide sequence including bases from both the N-terminal and C-terminal halves of the polypeptide. The same applies to C-terminal regions. One example of such a sequence if shown in FIG. 6, wherein the "polymerase domain" may be referred to a C-terminal region of the polypeptide even though it contains amino acids that are part of the N-terminal half of the polypeptide. N-terminal and C-terminal regions may, but need not, include the amino acid defining the ultimate N-terminal and C-terminal ends of the polypeptide, respectively.

As used herein, the terms "complementary" or "complementarity" are used in reference to polynucleotides (i.e., a sequence of nucleotides such as an oligonucleotide or a target nucleic acid) related by the base-pairing rules. For example, for the sequence "A-G-T," is complementary to the sequence "T-C-A." Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands. This is of particular importance in amplification reactions, as well as detection methods which depend upon binding between nucleic acids.

The term "homology" refers to a degree of identity. There may be partial homology or complete homology. A partially identical sequence is one that is less than 100% identical to another sequence.

As used herein, the term "hybridization" is used in reference to the pairing of complementary nucleic acids. Hybridization and the strength of hybridization (i.e., the strength of the association between the nucleic acids) is impacted by such factors as the degree of complementary between the nucleic acids, stringency of the conditions involved, the $T_m$ of the formed hybrid, and the G:C ratio within the nucleic acids.

As used herein, the term "$T_m$" is used in reference to the "melting temperature." The melting temperature is the temperature at which a population of double-stranded nucleic acid molecules becomes half dissociated into single strands. The equation for calculating the $T_m$ of nucleic acids is well known in the art. As indicated by standard references, a simple estimate of the $T_m$ value may be calculated by the equation: $T_m=81.5+0.41(\% \text{ G+C})$, when a nucleic acid is in aqueous solution at 1 M NaCl (See e.g., Anderson and Young, Quantitative Filter Hybridization, in *Nucleic Acid Hybridization* (1985). Other references include more sophisticated computations which take structural as well as sequence characteristics into account for the calculation of $T_m$.

As used herein the term "stringency" is used in reference to the conditions of temperature, ionic strength, and the presence of other compounds, under which nucleic acid hybridizations are conducted. With "high stringency" conditions, nucleic acid base pairing will occur only between nucleic acid fragments that have a high frequency of complementary base sequences. Thus, conditions of "weak" or "low" stringency are often required when it is desired that nucleic acids which are not completely complementary to one another be hybridized or annealed together.

The term "gene" refers to a DNA sequence that comprises control and coding sequences necessary for the production of a polypeptide or precursor. The polypeptide can be encoded by a full length coding sequence or by any portion of the coding sequence so long as the desired enzymatic activity is retained.

The term "wild-type" refers to a gene or gene product which has the characteristics of that gene or gene product when isolated from a naturally occurring source. A wild-type gene is that which is most frequently observed in a population and is thus arbitrarily designed the "normal" or "wild-type" form of the gene. In contrast, the term "modified" or "mutant" refers to a gene or gene product which displays modifications in sequence and or functional properties (i.e., altered characteristics) when compared to the wild-type gene or gene product. It is noted that naturally-occurring mutants can be isolated; these are identified by the fact that they have altered characteristics when compared to the wild-type gene or gene product.

The term "recombinant DNA vector" as used herein refers to DNA sequences containing a desired coding sequence and appropriate DNA sequences necessary for the expression of the operably linked coding sequence in a particular host organism. DNA sequences necessary for expression in prokaryotes include a promoter, optionally an operator sequence, a ribosome binding site and possibly other sequences. Eukaryotic cells are known to utilize promoters, polyadenlyation signals and enhancers.

The term "oligonucleotide" as used herein is defined as a molecule comprising two or more deoxyribonucleotides or ribonucleotides, preferably at least 5 nucleotides, more preferably at least about 10–15 nucleotides and more preferably at least about 15 to 30 nucleotides. The exact size will depend on many factors, which in turn depends on the ultimate function or use of the oligonucleotide. The oligonucleotide may be generated in any manner, including chemical synthesis, DNA replication, reverse transcription, or a combination thereof.

Because mononucleotides are reacted to make oligonucleotides in a manner such that the 5' phosphate of one mononucleotide pentose ring is attached to the 3' oxygen of its neighbor in one direction via a phosphodiester linkage, an end of an oligonucleotide is referred to as the "5' end" if its 5' phosphate is not linked to the 3' oxygen of a mononucleotide pentose ring and as the "3' end" if its 3' oxygen is not linked to a 5' phosphate of a subsequent mononucleotide pentose ring. As used herein, a nucleic acid sequence, even if internal to a larger oligonucleotide, also may be said to have 5' and 3' ends. A first region along a nucleic acid strand is said to be upstream of another region if the 3' end of the first region is before the 5' end of the second region when moving along a strand of nucleic acid in a 5' to 3' direction.

When two different, non-overlapping oligonucleotides anneal to different regions of the same linear complementary nucleic acid sequence, and the 3' end of one oligonucleotide points towards the 5' end of the other, the former may be called the "upstream" oligonucleotide and the latter the "downstream" oligonucleotide.

The term "primer" refers to an oligonucleotide which is capable of acting as a point of initiation of synthesis when placed under conditions in which primer extension is initiated. An oligonucleotide "primer" may occur naturally, as in a purified restriction digest or may be produced synthetically.

A primer is selected to be "substantially" complementary to a strand of specific sequence of the template. A primer must be sufficiently complementary to hybridize with a template strand for primer elongation to occur. A primer sequence need not reflect the exact sequence of the template. For example, a non-complementary nucleotide fragment may be attached to the 5' end of the primer, with the remainder of the primer sequence being substantially complementary to the strand. Non-complementary bases or longer sequences can be interspersed into the primer, provided that the primer sequence has sufficient complementarity with the sequence of the template to hybridize and thereby form a template primer complex for synthesis of the extension product of the primer.

"Hybridization" methods involve the annealing of a complementary sequence to the target nucleic acid (the sequence to be detected; the detection of this sequence may be by either direct or indirect means). The ability of two polymers of nucleic acid containing complementary sequences to find each other and anneal through base pairing interaction is a well-recognized phenomenon. The initial observations of the "hybridization" process by Marmur and Lane, *Proc. Natl. Acad. Sci. USA* 46:453 (1960) and Doty et al., *Proc. Natl. Acad. Sci. USA* 46:461 (1960) have been followed by the refinement of this process into an essential tool of modern biology.

With regard to complementarity, it is important for some diagnostic applications to determine whether the hybridization represents complete or partial complementarity. For example, where it is desired to detect simply the presence or absence of pathogen DNA (such as from a virus, bacterium, fungi, mycoplasma, protozoan) it is only important that the hybridization method ensures hybridization when the relevant sequence is present; conditions can be selected where both partially complementary probes and completely complementary probes will hybridize. Other diagnostic applications, however, may require that the hybridization method distinguish between partial and complete complementarity. It may be of interest to detect genetic polymorphisms. For example, human hemoglobin is composed, in part, of four polypeptide chains. Two of these chains are identical chains of 141 amino acids (alpha chains) and two of these chains are identical chains of 146 amino acids (beta chains). The gene encoding the beta chain is known to exhibit polymorphism. The normal allele encodes a beta chain having glutamic acid at the sixth position. The mutant allele encodes a beta chain having valine at the sixth position. This difference in amino acids has a profound (most profound when the individual is homozygous for the mutant allele) physiological impact known clinically as sickle cell anemia. It is well known that the genetic basis of the amino acid change involves a single base difference between the normal allele DNA sequence and the mutant allele DNA sequence.

The complement of a nucleic acid sequence as used herein refers to an oligonucleotide which, when aligned with the nucleic acid sequence such that the 5' end of one sequence is paired with the 3' end of the other, is in "antiparallel association." Certain bases not commonly found in natural nucleic acids may be included in the nucleic acids of the present invention and include, for example, inosine and 7-deazaguanine. Complementarity need not be perfect; stable duplexes may contain mismatched base pairs or unmatched bases. Those skilled in the art of nucleic acid technology can determine duplex stability empirically considering a number of variables including, for example, the length of the oligonucleotide, base composition and sequence of the oligonucleotide, ionic strength and incidence of mismatched base pairs.

The term "label" as used herein refers to any atom or molecule which can be used to provide a detectable (preferably quantifiable) signal, and which can be attached to a nucleic acid or protein. Labels may provide signals detectable by fluorescence, radioactivity, colorimetry, gravimetry, X-ray diffraction or absorption, magnetism, enzymatic activity, and the like. A label may be a charged moiety (positive or negative charge) or alternatively, may be charge neutral.

The term "cleavage structure" as used herein, refers to a structure which is formed by the interaction of at least one probe oligonucleotide and a target nucleic acid to form a complex having at least one region of base pairing before the probe and target, the resulting structure being cleavable by a cleavage agent, including but not limited to an enzyme. The cleavage structure is a substrate for specific cleavage by the cleavage agent, in contrast to a nucleic acid molecule which is a substrate for non-specific cleavage by agents such as phosphodiesterases which cleave nucleic acid molecules without regard to secondary structure (i.e., no formation of a duplexed structure is required).

The terms "cleavage means" and "cleavage agent" as used herein refer to any agent which is capable of cleaving a cleavage structure, including but not limited to enzymes (e.g., polymerases and flap endonucleases). The cleavage means may include native polymerases having 5' nuclease activity (e.g., Taq DNA polymerase, E. coli DNA polymerase I) and, more specifically, modified polymerases having 5' nuclease but lacking synthetic activity. "Structure-specific nuclcases" or "structure-specific enzymes" are enzymes which recognize specific secondary structures in a nucleic molecule and cleave these structures. The cleavage means of the invention cleave a nucleic acid molecule in response to the formation of cleavage structures; it is not necessary that the cleavage means cleave the cleavage structure at any particular location within the cleavage structure.

The cleavage means is not restricted to enzymes having solely 5' nuclease activity. The cleavage means may include nuclease activity provided from a variety of sources including, but not limited to, the CLEAVASE enzymes, the FEN-1 endonucleases (including RAD2 and XPG proteins), Taq DNA polymerase and E. coli DNA polymerase I.

The term "thermostable" when used in reference to an enzyme, such as a 5' nuclease, indicates that the enzyme is functional or active (i.e., can perform catalysis) at an elevated temperature, e.g., at about 55° C. or higher.

The term "cleavage products" as used herein, refers to products generated by the reaction of a cleavage means with a cleavage structure (i.e., the treatment of a cleavage structure with a cleavage means).

The term "non-target cleavage product" refers to a product of a cleavage reaction which is not derived from the target nucleic acid. As discussed above, in the methods of the present invention, cleavage of the cleavage structure occurs within the probe oligonucleotide. The fragments of the probe oligonucleotide generated by this target nucleic acid-dependent cleavage are "non-target cleavage products."

The term "substantially single-stranded" when used in reference to a nucleic acid substrate means that the substrate molecule exists primarily as a single strand of nucleic acid in contrast to a double-stranded substrate which exists as two strands of nucleic acid which are held together by inter-strand base pairing interactions.

The term "sequence variation" as used herein refers to differences in nucleic acid sequence between two nucleic acids. For example, a wild-type structural gene and a mutant form of this wild-type structural gene may vary in sequence by the presence of single base substitutions and/or deletions or insertions of one or more nucleotides. These two forms of the structural gene are said to vary in sequence from one another. A second mutant form of the structural gene may exist. This second mutant form is said to vary in sequence from both the wild-type gene and the first mutant form of the gene.

The term "liberating" as used herein refers to the release of a nucleic acid fragment from a larger nucleic acid fragment, such as an oligonucleotide, by the action of a 5' nuclease such that the released fragment is no longer covalently attached to the remainder of the oligonucleotide.

The term "$K_m$" as used herein refers to the Michaelis-Menten constant for an enzyme and is defined as the concentration of the specific substrate at which a given enzyme yields one-half its maximum velocity in an enzyme catalyzed reaction.

The term "nucleotide analog" as used herein refers to modified or non-naturally occurring nucleotides such as 7-deaza purines (i.e., 7-deaza-dATP and 7-deaza-dGTP). Nucleotide analogs include base analogs and comprise modified forms of deoxyribonucleotides as well as ribonucleotides.

The term "polymorphic locus" is a locus present in a population which shows variation between members of the population (i.e., the most common allele has a frequency of less than 0.95). In contrast, a "monomorphic locus" is a genetic locus at little or no variations seen between members of the population (generally taken to be a locus at which the most common allele exceeds a frequency of 0.95 in the gene pool of the population).

The term "microorganism" as used herein means an organism too small to be observed with the unaided eye and includes, but is not limited to bacteria, virus, protozoans, fungi, and ciliates.

The term "microbial gene sequences" refers to gene sequences derived from a microorganism.

The term "bacteria" refers to any bacterial species including eubacterial and archaebacterial species.

The term "virus" refers to obligate, ultramicroscopic, intracellular parasites incapable of autonomous replication (i.e., replication requires the use of the host cell's machinery).

The term "sample" in the present specification and claims is used in its broadest sense. On the one hand it is meant to include a specimen or culture (e.g., microbiological cultures or cultured eukaryotic tissue cells). On the other hand, it is meant to include both biological and environmental samples.

Biological samples may be animal, including human, fluid, solid (e.g., stool) or tissue, as well as liquid and solid food and feed products and ingredients such as dairy items, vegetables, meat and meat by-products, and waste. Biological samples may be obtained from all of the various families of domestic animals, as well as feral or wild animals, including, but not limited to, such animals as ungulates, bear, fish, lagamorphs, rodents, etc.

Environmental samples include environmental material such as surface matter, soil, water and industrial samples, as well as samples obtained from food and dairy processing instruments, apparatus, equipment, utensils, disposable and non-disposable items. These examples are not to be construed as limiting the sample types applicable to the present invention.

The term "source of target nucleic acid" refers to any sample which contains nucleic acids (RNA or DNA). Particularly preferred sources of target nucleic acids are biological samples including, but not limited to cultured cells, blood, saliva, cerebral spinal fluid, pleural fluid, milk, lymph, sputum, and semen.

An oligonucleotide is said to be present in "excess" relative to another oligonucleotide (or target nucleic acid sequence) if that oligonucleotide is present at a higher molar concentration relative to that of the other oligonucleotide (or target nucleic acid sequence). Typically, when present in excess, the probe oligonucleotide will be present at least a 100-fold molar excess.

A sample "suspected of containing" a first and a second target nucleic acid may contain either, both or neither target nucleic acid molecule.

The terms "polymerization means" or "polymerization agent" refer to any agent capable of facilitating the addition of nucleoside triphosphates to an oligonucleotide.

The terms "ligation means" or "ligation agent" refer to any agent capable of facilitating the ligation (i.e., the formation of a phosphodiester bond between a 3'-OH and a 5'-P located at the termini of two strands of nucleic acid). Preferred ligation means comprise DNA ligases and RNA ligases.

The term "reactant" is used herein in its broadest sense. In some embodiments, the reactant can comprise an enzymatic reactant, a chemical reactant or ultraviolet light (ultraviolet light, particularly short wavelength ultraviolet light is known to break oligonucleotide chains). Any agent capable of reacting with an oligonucleotide to either shorten (i.e., cleave) or elongate the oligonucleotide is encompassed within the term "reactant."

The terms "adduct" and "moiety" are used interchangeably, are used herein in their broadest sense to indicate any compound or element which can be added to an oligonucleotide. An adduct may be charged (positively or negatively) or may be charge neutral. An adduct may be added to the oligonucleotide via covalent or non-covalent linkages. Examples of adducts, include but are not limited to indodicarbocyanine dye amidites, amino-substituted nucleotides, ethidium bromide, ethidium homodimer, (1,3-propanediamino)propidium, (diethylenetriamino) propidium, thiazole orange, (N-N'-tetramethyl-1,3-propanediamino)propyl thiazole orange, (N-N'-tetramethyl-1,2-ethanediamino)propyl thiazole orange, thiazole orange-thiazole orange homodimer (TOTO), thiazole orange-thiazole blue heterodimer (TOTAB), thiazole orange-ethidium heterodimer 1 (TOED1), thiazole orange-ethidium heterodimer 2 (TOED2) and fluorescein-ethidium heterodimer (FED), psoralens, biotin, streptavidin, avidin, etc.

The term "recombinant DNA molecule" as used herein refers to a DNA molecule that comprises of segments of DNA joined together by means of molecular biological techniques.

The term "recombinant protein" or "recombinant polypeptide" as used herein refers to a protein molecule that is expressed from a recombinant DNA molecule.

As used herein the term "portion" when in reference to a protein (as in "a portion of a given protein") refers to fragments of that protein. The fragments may range in size from four amino acid residues to the entire amino acid sequence minus one amino acid.

"Nucleic acid sequence" as used herein refers to an oligonucleotide, nucleotide or polynucleotide, and fragments or portions thereof, and to DNA or RNA of genomic or synthetic origin which may be single- or double-stranded, and represent the sense or antisense strand. Similarly, "amino acid sequence" as used herein refers to peptide or protein sequence.

"Peptide nucleic acid" ("PNA") as used herein refers to a molecule which comprises an oligomer to which an amino acid residue, such as lysine, and an amino group have been added. These small molecules, also designated anti-gene agents, stop transcript elongation by binding to their complementary strand of nucleic acid (Nielsen et al., Anti-cancer Drug Des. 8:53 [1993]).

As used herein, the terms "purified" or "substantially purified" refer to molecules, either nucleic or amino acid sequences, that are removed from an environment, isolated or separated, and are at least 60% free, preferably 75% free, and most preferably 90% free from other components with which they were associated in the starting environment. The starting environment may be a natural one, as in the isolation of a non-recombinant protein, or it may be a created environment, as is the isolation of a recombinant protein from a host cell. For example, recombinant CLEAVASE nucleases may be expressed in bacterial host cells and the nucleases may be purified by the removal of host cell proteins; the percent of these recombinant nucleases is thereby increased in the sample. An "isolated polynucleotide" or "isolated oligonucleotide" is therefore a substantially purified polynucleotide.

As used herein, the term "fusion protein" refers to a chimeric protein containing the protein of interest joined to an exogenous protein fragment. The fusion partner may enhance solubility of recombinant chimeric protein as expressed in a host cell, may provide an affinity tag (e.g., a his-tag) to allow purification of the recombinant fusion protein from the host cell or culture supernatant, or both. If desired, the fusion protein may be removed from the protein of interest by a variety of enzymatic or chemical means known to the art.

As used herein, the terms "chimeric protein" and "chimerical protein" refer to a single protein molecule that comprises amino acid sequence portions derived from two or more parent proteins. These parent molecules may be similar proteins from genetically distinct origins, different proteins from a single organism, or dissimilar proteins from different organisms. By way of example but not by way of limitation, a chimeric structure-specific nuclease of the present invention may contain a mixture of amino acid sequences that have been derived from DNA polymerase genes from two or more of the organisms having such genes, combined to form a non-naturally occurring 5' nuclease. The term "chimerical" as used herein is not intended to convey any particular proportion of contribution from the naturally occurring genes, nor limit the manner in which the portions are combined. Any chimeric structure-specific nuclease constructs having cleavage activity as determined by the testing methods described herein, for example, are improved cleavage agents within the scope of the present invention.

DETAILED DESCRIPTION OF THE INVENTION

The INVADER invasive cleavage reaction has been shown to be useful in the detection of RNA target strands (See e.g., U.S. Pat. No. 6,001,567, incorporated herein by reference in its entirety). As with the INVADER assay for the detection of DNA (Lyamichev et al., Nat. Biotechnol., 17:292 [1999]), the reactions may be run under conditions that permit the cleavage of many copies of a probe for each copy of the target RNA present in the reaction. In one embodiment, the reaction may be performed at a temperature close to the melting temperature ($T_m$) of the probe that is cleaved, such that the cleaved and uncleaved probes readily cycle on and off the target strand without temperature cycling. Each time a full-length probe binds to the target in the presence of the INVADER oligonucleotide, it may be cleaved by a 5' nuclease enzyme, resulting in an accumulation of cleavage product. The accumulation is highly specific for the sequence being detected, and may be configured to be proportional to both time and target concentration of the reaction. In another embodiment, the temperature of the reaction may be shifted (i.e., it may be raised to a temperature that will cause the probe to dissociate) then lowered to a temperature at which a new copy of the probe hybridizes to the target and is cleaved by the enzyme. In a further embodiment, the process of raising and lowering the temperature is repeated many times, or cycled, as it is in PCR (Mullis and Faloona, Methods in Enzymology, 155:335 [1987], Saiki et al., Science 230:1350 [1985]).

As noted above, 5' nucleases of Pol A type DNA polymerases are preferred for cleavage of an invasive cleavage structure that comprises an RNA target strand. The present invention provides enzymes having improved performance in detection assays based on the cleavage of a structure comprising RNA. In particular, the altered polymerases of the present invention exhibit improved performance in detection assays based on the cleavage of a DNA member of an invasive cleavage structure that comprises an RNA target strand.

Figure 5:
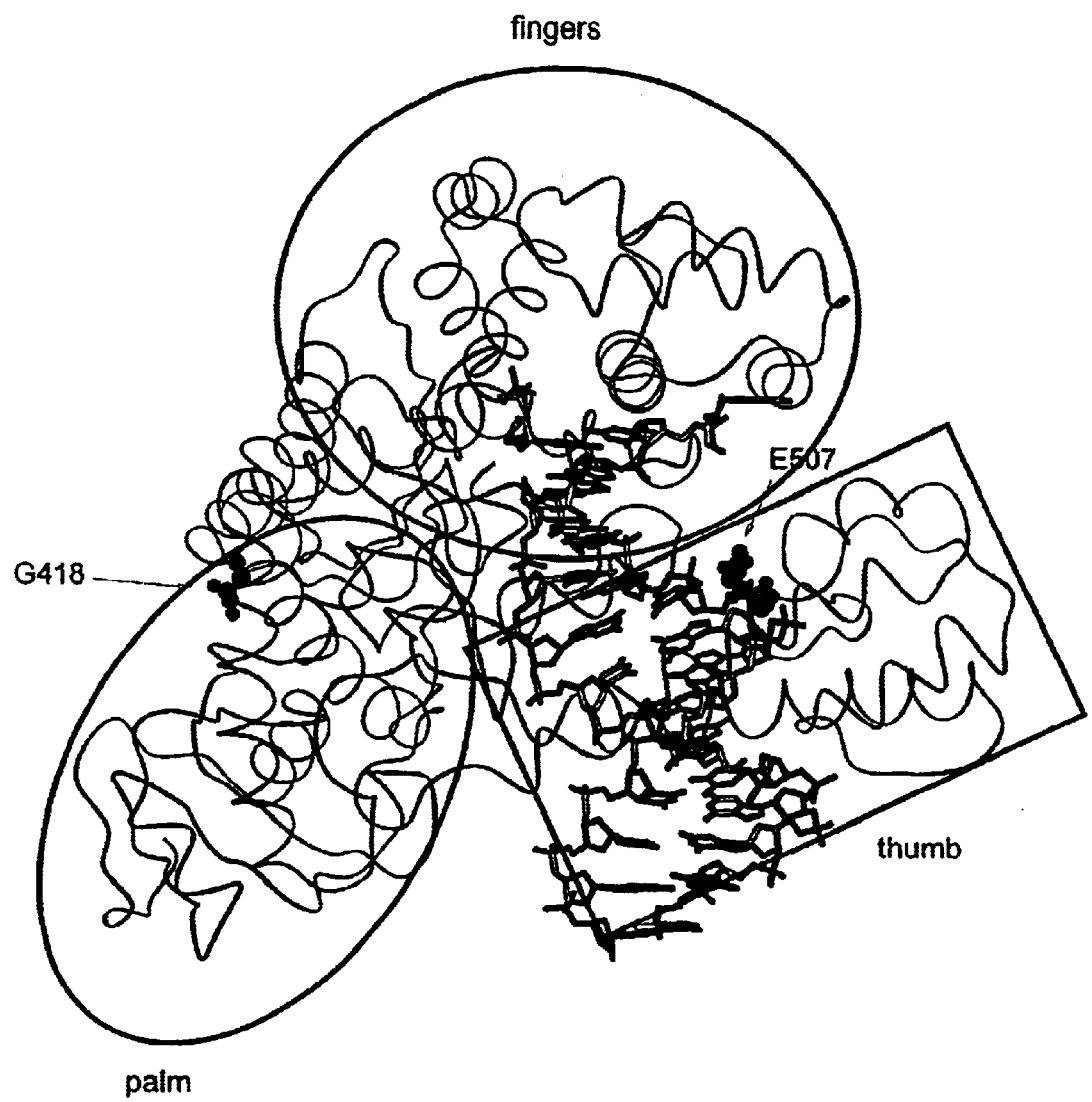
FIG. 5 shows a diagram of the X-ray structure of a ternary complex of Klentaq1 with primer/template DNA in the polymerizing mode determined by Li et al. (Li et al., Protein Sci., 7:1116 [1998]). Without intending to represent precise borders between features of the physical form, the portions referred to in the text as the "fingers", "thumb" and "palm" regions are loosely indicated by the circle, rectangle, and oval, respectively.
Figure 6:
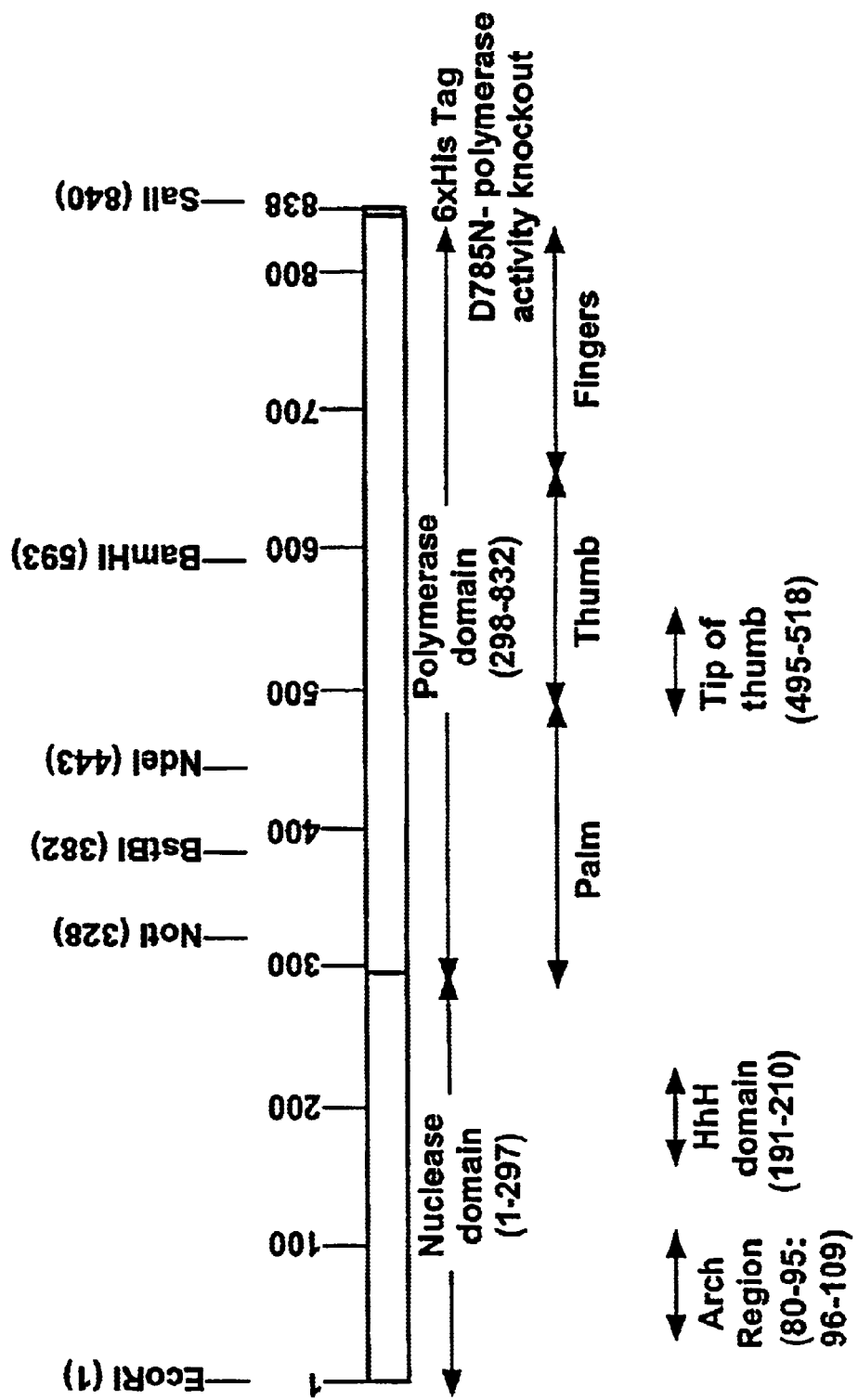
FIG. 6 shows a schematic diagram of the DNA polymerase gene from Thermus aquaticus. Restriction sites used in these studies are indicated above. The approximate regions encoding various structural or functional domains of the protein are indicated by double-headed arrows, below.

The 5' nucleases of the present invention may be derived from Pol A type DNA polymerases. The terminology used in describing the alterations made in this class of 5' nucleases relates to the descriptions of DNA polymerase structures known in the art. The Klenow fragment of the Pol A polymerase from *E. coli* (the C-terminal two thirds, which has the DNA synthesizing activity but lacks the 5' nuclease activity) has been described as having a physical form resembling a right hand, having an open region called the "palm", and a cleft that holds the primer/template duplex defined on one side by a "fingers" domain and on the other by a "thumb" domain (Joyce and Steitz, Trends in Biochemical Science 12:288 [1987]). This is shown schematically in FIG. 5. Because this physical form has proved to be common to all Pol A DNA polymerases and to a number of additional template-dependent polymerizing enzymes such as reverse transcriptases, the hand terminology has become known in the art, and the sites of activity in these enzymes are often described by reference to their position on the hand. For reference, and not intended as a limitation on the present invention, the palm is created from roughly the first 200 amino acids of the polymerase domain, the thumb from the middle 140, and the fingers by the next 160, with the base of the cleft formed from the remaining regions (FIG. 6). Although some enzymes may deviate from these structural descriptions, the equivalent domains and sequences corresponding to such domains may be identified by sequence homology to known enzyme sequences, by comparison of enzyme crystal structures, and other like methods.

In creating the improved enzymes of the present invention, several approaches have been taken, although the present invention in not limited to any particular approach. First two DNA polymerases, Taq and Tth, that have different rates of DNA strand cleavage activity on RNA targets were compared. To identify domains related to the differences in activity, a series of chimerical constructs was created and the activities were measured. This process identified two regions of the Tth polymerase that could, if transferred into the Taq polymerase, confer on the TaqPol an RNA-dependent cleavage activity equivalent to that of the native Tth protein. Once these regions were identified, the particular amino acids involved in the activity were examined. Since the two proteins are about 87 percent identical in amino acid sequence overall, the identified regions had only a small number of amino acid differences. By altering these amino acids singly and in combinations, a pair of amino acids were identified in TthPol that, if introduced into the TaqPol protein, increased the rate of cleavage up to that of the native TthPol.

These data demonstrate two important aspects of the present invention. First, specific amino acids can be changed to confer TthPol-like RNA-dependent cleavage activity on a polymerase having a lesser activity. More broadly, however, these results provide regions of these polymerases that are involved in the recognition of the RNA-containing cleavage structure. Identification of these important regions, combined with published information on the relationships of other amino acids to the various functions of these DNA polymerases and computer-assisted molecular modeling during the development of the present invention have allowed a rational design approach to create additional improved 5' nucleases. The information also allowed a focused random mutagenesis approach coupled with a rapid screening procedure to quickly create and identify enzymes having improved properties. Using these methods of the present invention, a wide array of improved polymerases are provided.

The methods used in creating and selecting the improved 5' nucleases of the present invention are described in detail below and in the experimental examples. A general procedure for screening and characterizing the cleavage activity of any 5' nuclease is included in the experimental examples. The methods discussions are divided into the following sections: I) Creation and selection of chimerical constructs; II) Site-specific mutagenesis based on information from chimerical constructs; III) Site-specific mutagenesis based on molecular modeling and published physical studies; and IV) focused random mutagenesis.

I) Creation and Selection of Chimerical Constructs

The PolA-type DNA polymerases, including but not limited to DNA polymerase enzymes from Thermus species, comprise two distinctive domains, the 5' nuclease and the polymerase domains, shown schematically in FIG. 6. The polymerase domains reside in the C-terminal two-thirds of the proteins and are responsible for both DNA-dependent and RNA-dependent DNA polymerase activities. The N-terminal one-third portions contain the 5' nuclease domains. In the genus Thermus Pol A polymerase, the palm region consists of, roughly, amino acids 300–500, the thumb region includes amino acids 500–650, while the fingers region is formed by the remaining amino acids from 650 to 830 (FIG. 6).

The derivatives, Taq DN RX HT and Tth DN RX HT, of Taq and TthPol used in many of the experiments of the present invention, and described herein, are modified to reduce synthetic activity and to facilitate chimera construction, but have 5' nuclease activity essentially identical to unmodified TaqPol and TthPol. Unless otherwise specified, the TaqPol and TthPol enzymes of the following discussion refer to the DN RX HT derivative.

Figure 8A:
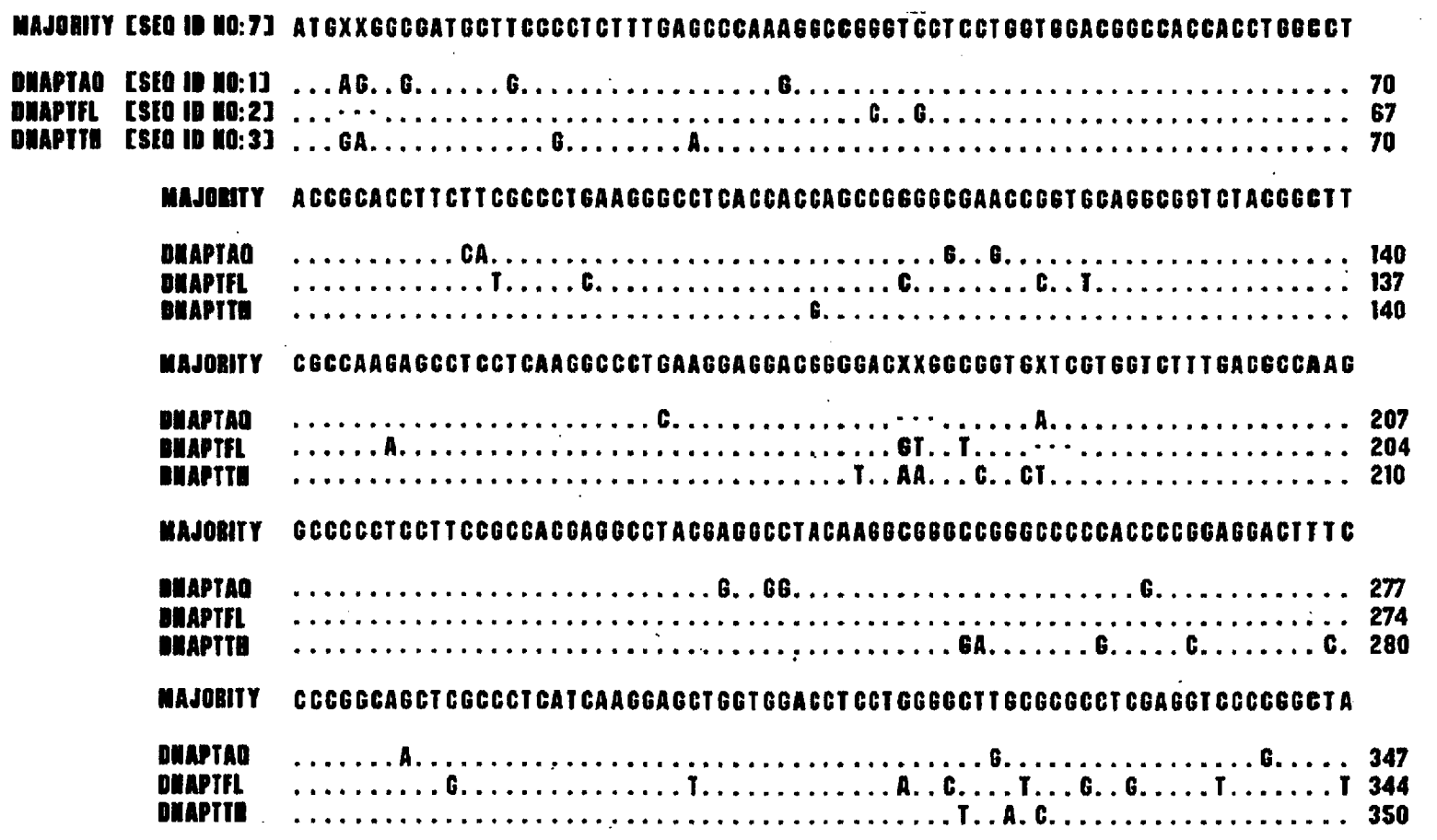
Figure 8B:
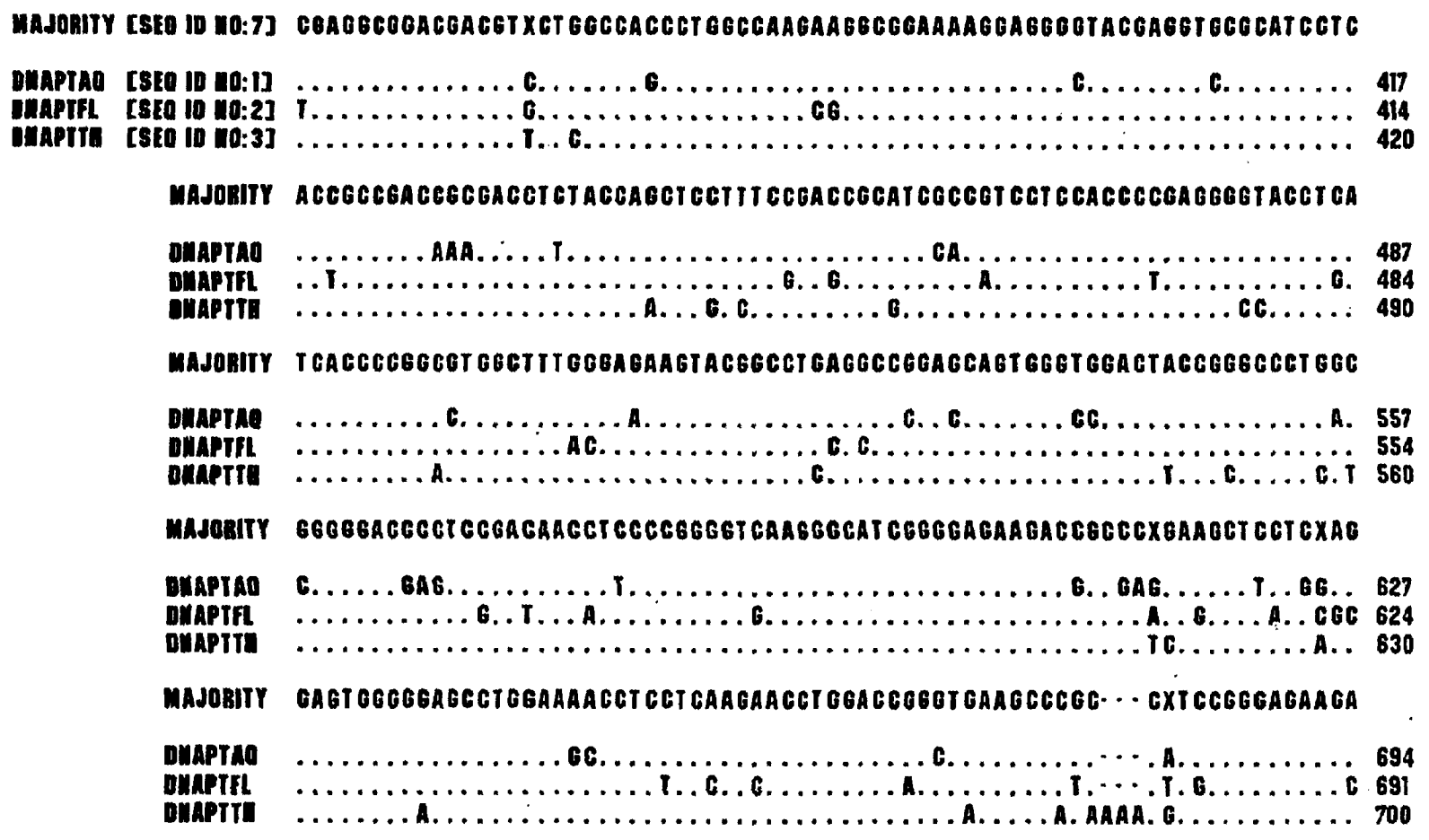
Figure 8D:
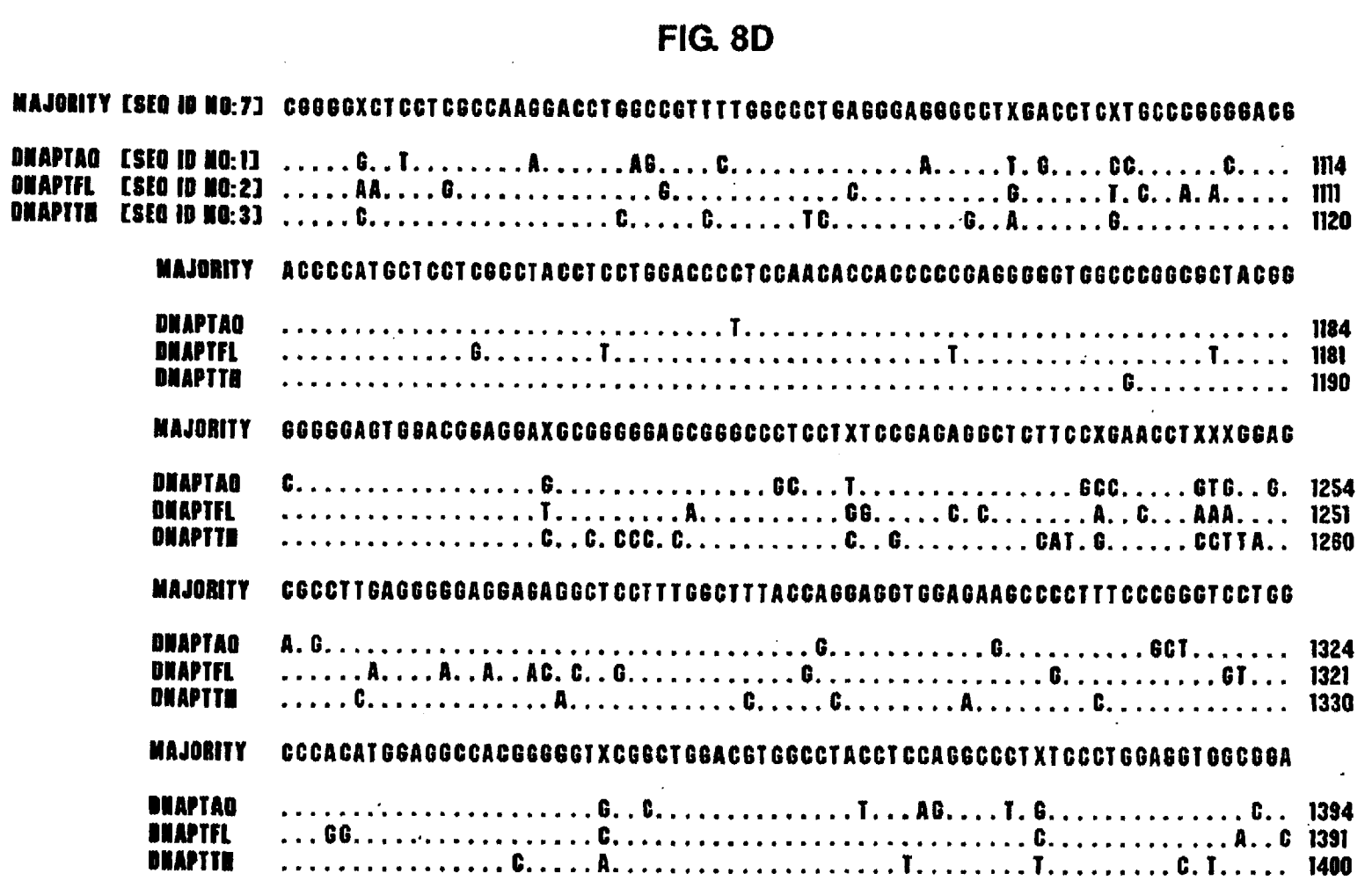
Figure 10:
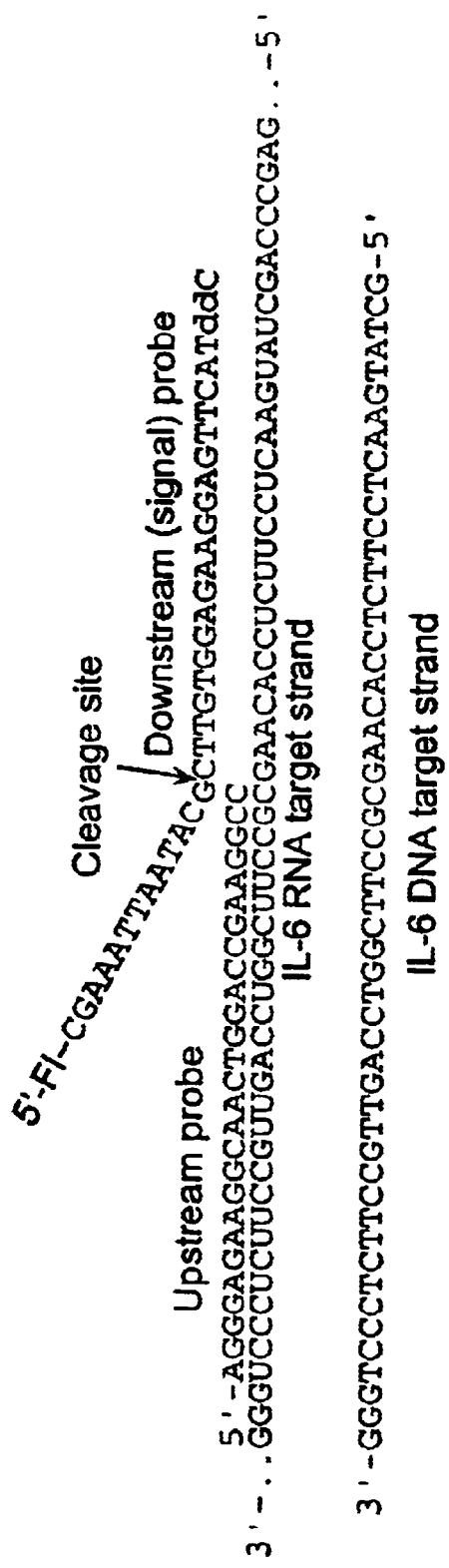
FIG. 10 shows the sequences and proposed structures of substrates for the invasive signal amplification reaction with human IL-6 RNA target strand (SEQ ID NO:17) and upstream probe (SEQ ID NO:15). The cleavage site of the downstream probe (SEQ ID NO:16) is indicated by an arrow. Sequence of the IL-6 DNA target strand (SEQ ID NO:18) is shown below.

TthPol has a 4-fold higher cleavage rate with the IL-6 RNA template (shown in FIG. 10) than TaqPol (shown in FIGS. 11 and 12), although the Taq and TthPols show similarities of cleavage in DNA target structures (FIG. 10). Since the amino acid sequences of TaqPol and TthPol (FIGS. 8 and 9) share about 87% identity and greater than 92% similarity, the high degree of homology between the enzymes allowed creation of a series of chimeric enzymes between TthPol and TaqPol. The activity of the chimeric enzymes was used as a parameter to identify the region(s) of these proteins affecting RNA dependent 5' nuclease activity.

Figure 7:
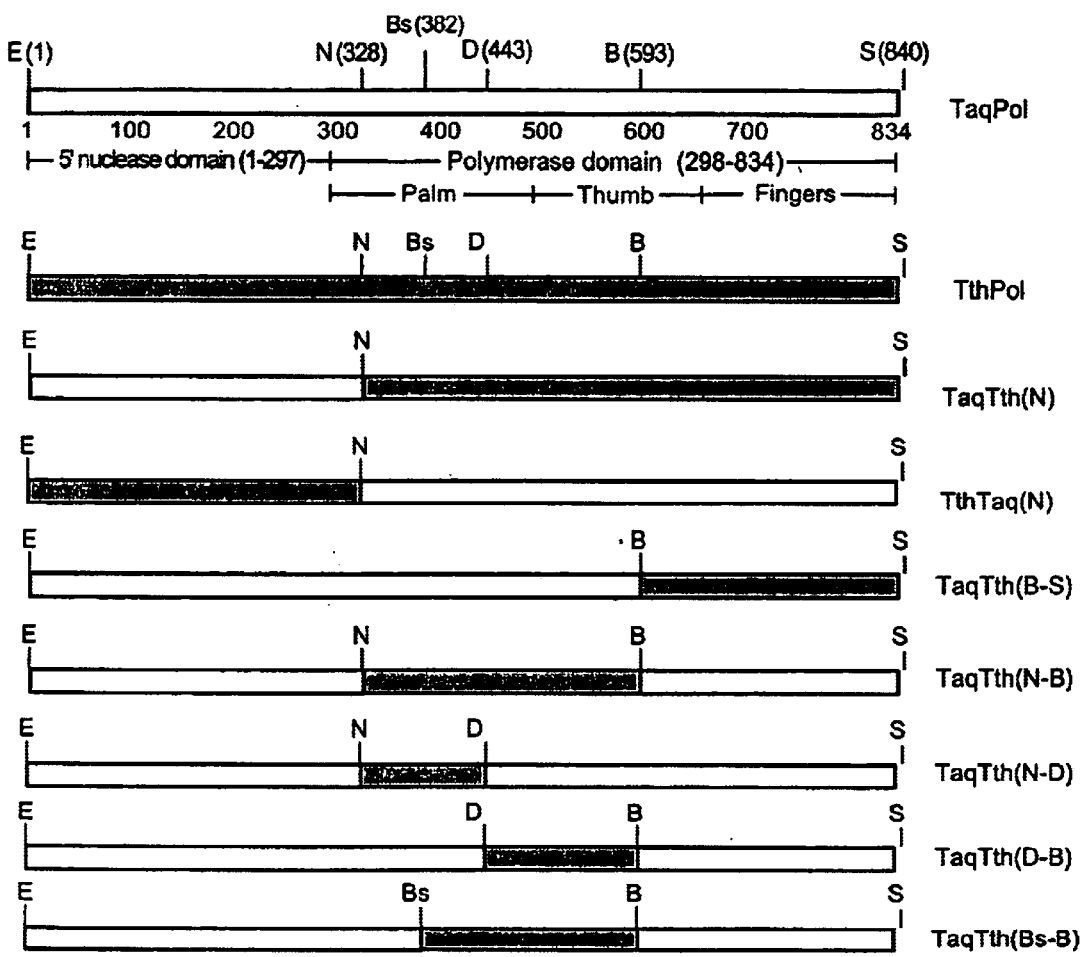
FIG. 7 shows a schematic diagram of the chimeric constructs comprising portions of the TaqPol gene and the TthPol gene. Open and shaded boxes denote TaqPol and TthPol sequences, respectively. The numbers correspond to the amino acid sequence of TaqPol. The 5' nuclease and polymerase domains of TaqPol and the palm, thumb, and fingers regions of the polymerase domain are indicated. The abbreviations for the restrictions sites used for recombination are as follows: E, EcoRI; N, NotI; Bs, BstBI; D, NdeI; B, BamHI; and S, SalI.
Figure 19:
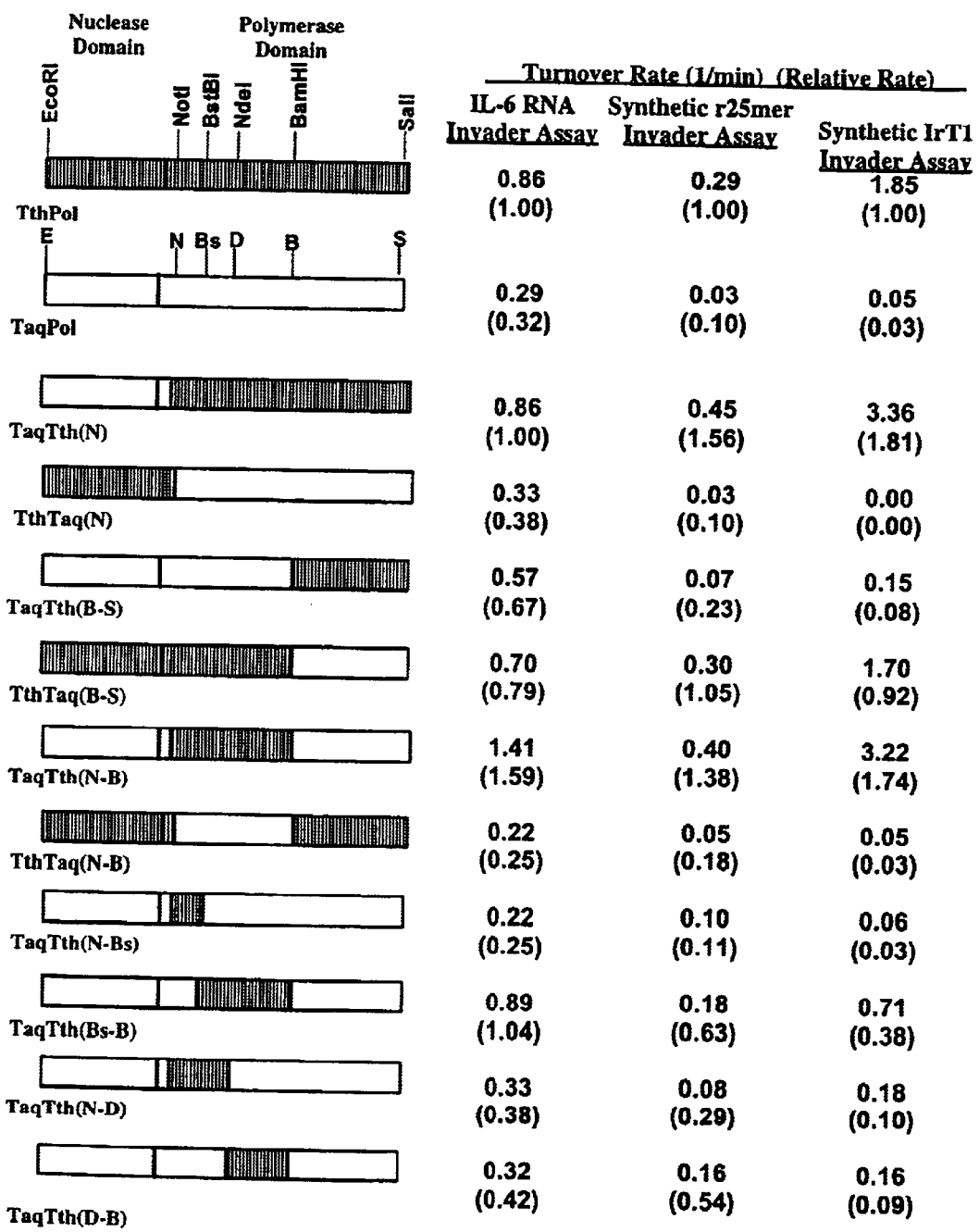
FIG. 19 shows schematic diagrams of chimeric constructs comprising portions of the TaqPol gene and the TthPol gene. Open and shaded boxes denote TaqPol and TthPol sequences, respectively. The chimeras also include the DN, RX, and HT modifications. A table compares the cleavage activity of each protein on the indicated cleavage substrates.

The chimeric constructs between TthPol and TaqPol genes shown schematically in FIGS. 7 and 19 were created by swapping DNA fragments defined by the restriction endonuclease sites, EcoRI and BamHI, common for both genes, the cloning vector site SalI and the new sites, NotI, BstBI and NdeI, created at the homologous positions of both genes by site directed mutagenesis. The restriction enzymes have been abbreviated as follows: EcoRI is E; NotI is N; BstBI is Bs; NdeI is D, BamHI is B, and SalI is S.

Figure 12:
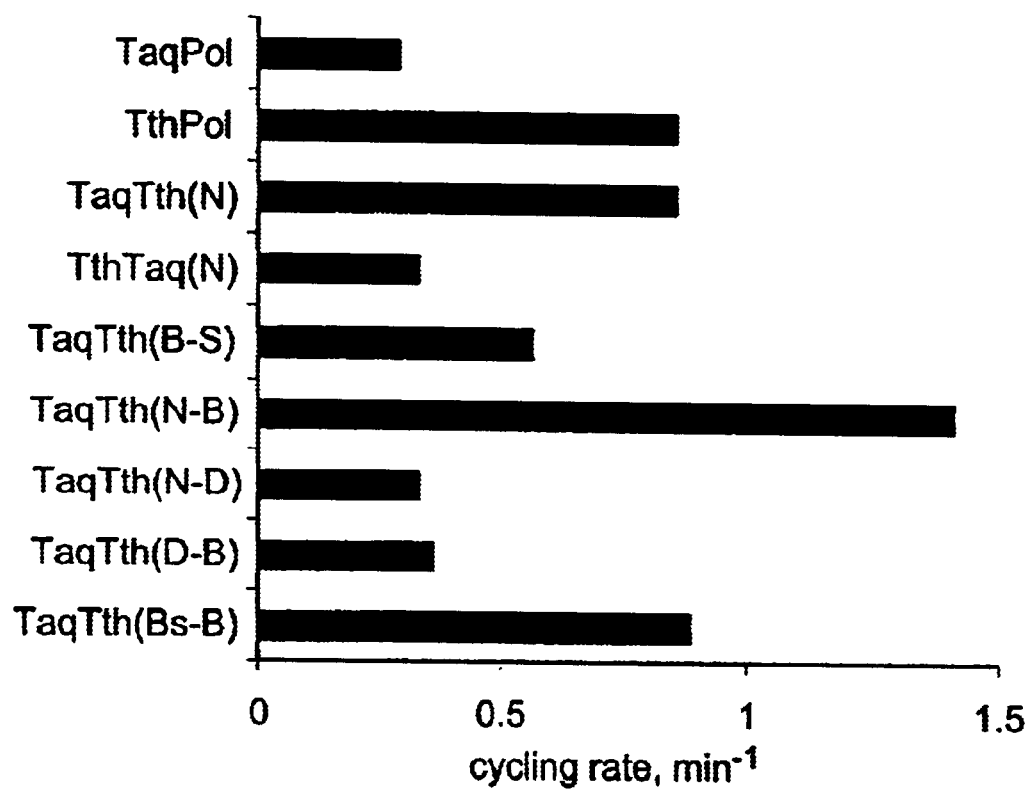
FIG. 12 compares the cycling cleavage activities of Taq DN RX HT, Tth DN RX HT, and Taq-Tth chimerical enzymes with IL-6 substrate having an RNA target strand.

The activity of each chimeric enzyme was evaluated using the invasive signal amplification assay with the IL-6 RNA target (FIG. 10), and the cycling cleavage rates shown in FIG. 12 were determined as described in the Experimental Examples. Comparison of the cleavage rates of the first two chimeras, TaqTth(N) and TthTaq(N), created by swapping the polymerase and 5' nuclease domains at the NotI site (FIG. 7), shows that TaqTth(N) has the same activity as TthPol, whereas its counterpart TthTaq(N) retains the activity of TaqPol (FIG. 12). This result indicates that the higher cleavage rate of TthPol is associated with its polymerase domain and suggests an important role of the polymerase domain in the 5' nuclease activity.

The next step was to identify a minimal region of TthPol polymerase that would give rise to the TthPol-like RNA dependent 5' nuclease activity when substituted for the corresponding region of the TaqPol sequence. To this end, the TaqTth(N) chimera was selected to generate a series of new constructs by replacing its TthPol sequence with homologous regions of TaqPol. First, the N-terminal and C-terminal parts of the TaqPol polymerase domain were substituted for the corresponding regions of TaqTth(N) using the common BamHI site as a breaking point to create TaqTth(N-B) and TaqTth(B-S) chimeras, respectively (FIG. 7). TaqTth(N-B) which has the TthPol sequence between amino acids 328 and 593, is approximately 3 times more active than the TaqTth(B-S) and 40% more active than TthPol (FIG. 12). This result establishes that the NotI-BamHI portion of the TthPol polymerase domain determines superior RNA-dependent 5' nuclease activity of TthPol.

From these data it was determined that a central portion of the TthPol, when used to replace the homologous portion of TaqPol (TaqTth(N-B) construct) could confer superior RNA recognition on the chimerical protein composed primarily of Taq protein. In fact, the cycling rate of this chimerical protein exceeded that of the parent TthPol. Comparison of chimeras that included sub-portions of the activity-improving region of TthPol, approximately 50% of the region in each case (See, TaqTth(N-D) and TaqTth(D-B), FIGS. 7 and 12) showed no significant improvement in RNA dependent activity as compared to the parent TaqPol. This result indicates that aspects of each half of the region are required for this activity. A construct having an only slightly smaller portion of the Tth insert portion (TaqTth(Bs-B)) showed activity that was close to that of the parent TthPol protein, but which was less than that of the TaqTth(N-B) construct.

II) Site-specific Mutagenesis Based on Information from Chimerical Constructs

Comparison of the TthPol and TaqPol amino acid sequences between the BstBI and BamHI sites reveals only 25 differences (FIG. 13). Among those, there are 12 conservative changes and 13 substitutions resulting in a change in charge. Since the analysis of the chimeric enzymes has suggested that some critical amino acid changes are located in both BstBI-NdeI and NdeI-BamHI regions of TthPol, site directed mutagenesis was used to introduce the TthPol specific amino acids into the BstBI-NdeI and NdeI-BamHI regions of the TaqTth(D-B) and TaqTth (N-D) chimeras, respectively. Six TthPol-specific substitutions were generated in the BstBI-NdeI region of the TaqTth(D-B) by single or double amino acid mutagenesis and only one double mutation, W417L/G418K, was able to restore the TthPol activity with the IL-6 RNA target (See e.g., FIG. 14). Similarly, 12 TthPol specific amino acids were introduced at the homologous positions of the NdeI-BamHI region of the TaqTth(N-D) and only one of them, E507Q, increased the cleavage rate to the TthPol level (See e.g., FIG. 14).

Figure 15:
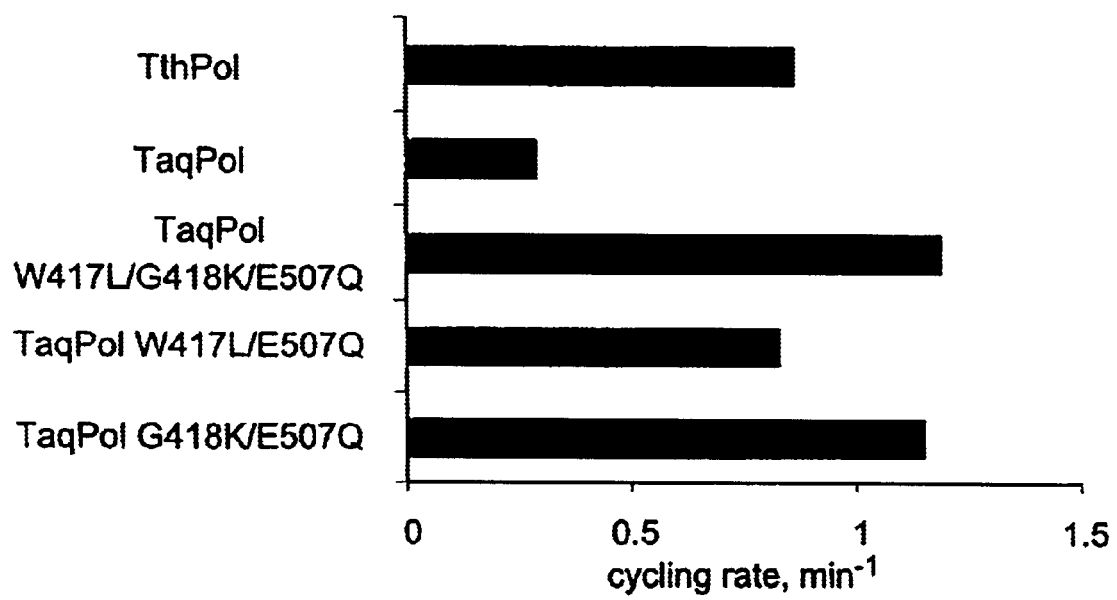
FIG. 15 compares the cycling cleavage activities of Taq DN RX HT, Tth DN RX HT, and Taq DN RX HT having the indicated amino acid modifications, with IL-6 substrate having an RNA target strand.

To confirm that the W417L, G418K and E507Q substitutions are sufficient to increase the TaqPol activity to the TthPol level, TaqPol variants carrying these mutations were created and their cleavage rates with the IL-6 RNA substrate were compared with that of TthPol. FIG. 15 shows that the TaqPol W417L/G418K/E507Q and TaqPol G418K/E507Q mutants have 1.4 times higher activity than TthPol and more than 4 fold higher activity than TaqPol, whereas the TaqPol W417L/E507Q mutant has the same activity as TthPol, which is about 3 fold higher than TaqPol. These results demonstrate that K418 and Q507 of TthPol are important amino acids in defining its superior RNA dependent 5' nuclease activity compared to TaqPol.

Figure 25:
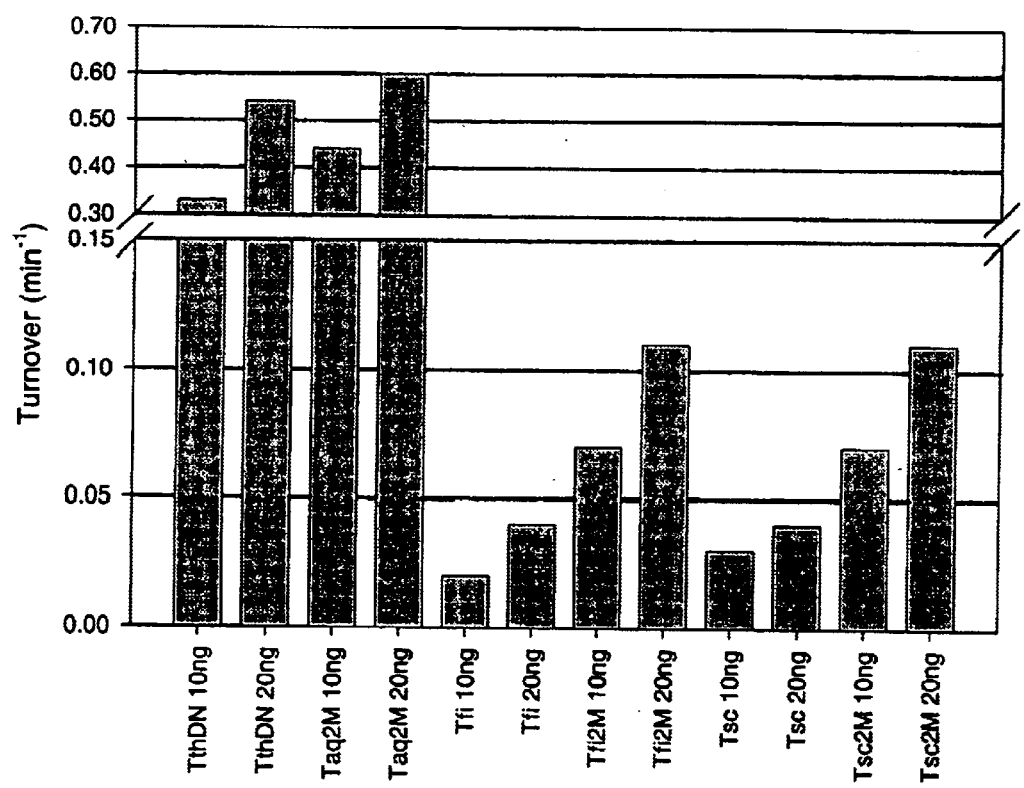
FIG. 25 compares the cycling cleavage activities of Tth DN RX HT, Taq 2M, TfiPol, Tsc Pol, and Tfi and Tsc-derived mutant enzymes.

The ability of these amino acids to improve the RNA dependent 5' nuclease activity of a DNA polymerase was tested by introducing the corresponding mutations into the polymerase A genes of two additional organisms: *Thermus filiformus* and *Thermus scotoductus*. TaqPol showed improved RNA dependent activity when it was modified to contain the W417L and E507Q mutations, which made it more similar at these residues to the corresponding residues of TthPol (K418 and Q507). The TfiPol was modified to have P420K and E507Q, creating TfiDN 2M, while the TscPol was modified to have E416K and E505Q, to create TscDN 2M. The activity of these enzymes for cleaving various DNA and RNA containing structures was determined as described in Example 1, using the IdT2, IrT3, hairpin and X-structures diagrammed in FIGS. 21 and 22, with the results shown in both FIG. 25 and Table 7. Both enzymes have much less RNA-dependent cleavage activity than either the TthPol or the Taq 2M enzymes. However, introduction of the mutations cited above into these polymerases increased the RNA dependent cleavage activity over 2 fold compared to the unmodified enzymes (FIG. 25). These results demonstrate that transferability of improved RNA dependent cleavage activity into a wide range of polymerases using the methods of the present invention.

Figure 17:
FIG. 17 shows a diagram of the X-ray structure of a ternary complex of Klentaq1 with primer/template DNA in the polymerizing mode determined by Li et al. (Li et al., Protein Sci., 7:1116 [1998]). Amino acids G418 and E507 are indicated.

III) Site-specific Mutagenesis Based on Molecular Modeling and Published Physical Studies The positions of the G418H and E507Q mutations in the crystal structure of a complex of the large fragment of TaqPol (Klentaq1) with a primer/template DNA determined by Li et al. (Li et al., Protein Sci., 7:1116 [1998]) are shown in FIG. 17. The E507Q mutation is located at the tip of the thumb subdomain at a nearest distance of 3.8 Å and 18 Å from the backbone phosphates of the primer and template strands, respectively. The interaction between the thumb and the minor groove of the DNA primer/template was previously suggested by the co-crystal structures of Klenow fragment DNA polymerase I (Breese et al., Science 260:352 [1993]) and TaqPol (Eom et al., Nature 382:278 [1996]). Deletion of a 24 amino acid portion of the tip of the thumb in Klenow fragment, corresponding to amino acids 494–518 of TaqPol, reduces the DNA binding affinity by more than 100-fold (Minnick et al., J. Biol. Chem., 271:24954 [1996]). These observations are consistent with the hypothesis that the thumb region, which includes the E507 residue, is involved in interactions with the upstream substrate duplex.

The W417L and G418K mutations in the palm region of TaqPol (FIG. 17) are located approximately 25 Å from the nearest phosphates of the template and upstream strands, according to the co-crystal structures of TaqPol with duplex DNA bound in the polymerizing mode (Li et al., Protein Sci., 7:1116 [1998], Eom et al., Nature 382:278 [1996]). The same distance was observed between the analogous W513 and P514 amino acids of Klenow fragment and the template strand of DNA bound in the editing mode (Breese et al., Science 260:352 [1993]). Thus, no interactions between TaqPol and the overlapping substrate can be suggested from the available co-crystal studies for this region.

Although an understanding of the mechanism of action of the enzymes is not necessary for the practice of the present invention and the present invention is not limited to any mechanism of action, it is proposed that the amino acids at positions 417 and 418 in the palm region of TaqPol interact with the upstream substrate duplex only when the enzyme functions as a 5' nuclease, but no interaction with these amino acids occurs when TaqPol switches into polymerizing mode. This hypothesis suggests a novel mode of substrate binding by DNA polymerases called here the "5' nuclease mode." Several lines of evidence support this hypothesis. The study of the chimeric enzymes described here clearly separates regions of the polymerase domain involved in the 5' nuclease and polymerase activities. Accordingly, the W417L and G418K mutations, together with the E507Q mutation, affect the 5' nuclease activity of TaqPol on substrates having an RNA target strand (FIG. 15), but have no effect on either RNA-dependent or DNA-dependent DNA polymerase activities (FIG. 16). On the other hand, mutations in the active site of TaqPol, such as R573A, R587A, E615A, R746A, N750A and D785N, which correspond to substitutions in Klenow fragment of *E.coli* DNA Pol I that affect both polymerase activity and substrate binding affinity in the polymerizing mode (Polesky et al., J. Biol. Chem., 265:14579 [1990], Polesky et al., J. Biol. Chem., 267:8417 [1992], Pandey et al., Eur. J. Biochem., 214:59 [1993]) were shown to have little or no effect on the 5' nuclease activity. Superposition of the polymerase domains of TaqPol (Eom et al., Nature 382:278 [1996]), *E.coli* Pol I and *Bacillus stearothermophilus* Pol I (Kiefer et al., Nature 391:304 [1998]) using the programs DALI (Holm and Sander, J. Mol. Biol., 233:123 [1993], Holm and Sander, Science 273:595 [1996]) and Insight II (Molecular Simulation Inc., Naperville, Ill.) shows that the palm region of TaqPol between amino acids 402–451, including W417 and G418, is structurally highly conserved between the three polymerases, although there is no structural similarity between the rest of the palm subdomains. This observation suggests an important role for this region in eubacterial DNA polymerases.

The 5' nuclease and polymerase activities should be precisely synchronized to create a nicked structure rather than a gap or an overhang that could cause a deletion or an insertion during Okazaki fragment processing or DNA repair, if ligase joins the ends inappropriately. According to the previously proposed model (Kaiser et at., J. Biol. Chem., 274:21387 [1999]), the 3' terminal nucleotide of the upstream strand is sequestered by the 5' nuclease domain to prevent its extension, thus halting synthesis. The interaction with the 3' nucleotide apparently activates the 5' nuclease that endonucleolitically removes the displaced 5' arm of the downstream strand. This cleavage occurs by the precise incision at the site defined by the 3' nucleotide, thus creating the nick. This model requires a substantial rearrangement of the substrate-enzyme complex, which may include a translocation of the complex to the 5' nuclease mode to separate the primer/template from the polymerase active site.

It is possible that a relocation of the substrate away from the polymerase active site could be induced by the interaction between the duplex formed between the template and incoming strands and the crevice formed by the finger and thumb subdomais. Such an interaction could force conformational transitions in the thumb that would bring the template/primer duplex into close contact with the W417 and G418 amino acids. Significant flexibility of the thumb has been previously reported that might explain such changes (Beese et al., Science 260:352 [1993], Eom et al., Nature 382:278 [1996], Ollis et al., Nature 313:762 [1985], Kim et al., Nature 376:612 [1995], Korolev et al., Proc. Natl. Acad. Sci., 92:9264 [1995], Li et al., EMBO J., 17:7514 [1998]). Additional conformational changes of the fingers domain that might help to open the crevice, such as the transition from the 'closed' to the 'open' structure described by Li et al. (Li et al., EMBO J., 17:7514 [1998]), are consistent with this model. It may be that the 5' nuclease binding mode was not observed in any of the published co-crystal structures of a DNA Pol I because the majority of the structures were solved for the polymerase domain only, with a template/primer substrate rather than with an overlapping 5' nuclease substrate.

$K_m$ values of 200–300 nM have been determined for TaqPol, TthPol and TaqPol G418K/E507Q for the RNA containing substrate. These values are much higher than the $K_m$ value of <1 nM estimated for TthPol with an all-DNA overlapping substrate suggesting that the RNA template adversely affects substrate binding. The low affinity could be explained by the unfavorable interaction between the enzyme and either the A-form duplex adopted by the substrate with an RNA target, or the ribose 2' hydrolysis of the RNA strand. Between these two factors, the latter seems more likely, since the 5' nucleases of eubacterial DNA polymerases can efficiently cleave substrates with an RNA downstream probe (Lyamichev et al., Science 260:778 [1993]), which would presumably have an A-form. Further, the co-crystal studies suggest that the template/primer duplex partially adopts a conformation close to A-form in its complex with DNA polymerase (Eom et al., Nature 382:278 [1996], Kiefer et al., Nature 391:304 [1998], Li et al., EMBO J., 17:7514 [1998]). The G418K/E507Q mutations increase the $k_{cat}$ of TaqPol more than two fold, but have little effect on $K_m$. Such an effect would be expected if the mutations position the substrate in an orientation more appropriate for cleavage rather than simply increasing the binding constant.

In addition to the mutational analysis described above, another approach to studying specific regions of enzymes, enzyme structure-function relationships, and enzyme-substrate interaction is to investigate the actual, physical structure of the molecule.

With the advances in crystallographic, NMR, and computer and software technology, study of molecular structure has become a viable tool for those interested in the configuration, organization, and dynamics of biomolecules. Molecular modeling has increased the understanding of the nature of the interactions that underlie the structure of proteins and how proteins interact functionally with substrate. Numerous publications describing the structures of various polymerases or polymerase protein portions, HIV reverse transcriptase, and other nucleic acid binding proteins have provided mechanistic insights into protein conformation, changes in conformation, and molecular interactions necessary for function.

As an example, the report by Doublie et at. (Doublie et al., Nature 391:251 [1998]) discloses the crystal structure of T7 DNA polymerase and provides information about which amino acid regions are likely to have an affect on substrate binding, which are required to contact the substrate for polymerization, and which amino acids bind cofactors, such as metal ions. It is noted in this paper and others that many of the polymerases share not only sequence similarity, but structural homology as well. When certain structural domains of different polymerases are superimposed (for example, T7 polymerase, Klenow fragment editing complex, the unliganded Taq DNA polymerase and the Taq Polymerase-DNA complex) conserved motifs are clearly discernable.

Specifically, combining the information from all of these different structural sources and references, a model of the protein interacting with DNA, RNA, or heteroduplex can be made. The model can then be examined to identify amino acids that may be involved in substrate recognition or substrate contact. Changes in amino acids can be made based on these observations, and the effects on the various activities of the 5' nuclease proteins are assessed using screening methods such as those of the present invention, described in the experimental examples.

The domain swapping analysis discussed previously demonstrated that sequences of TthDN that are important in RNA-dependent 5' nuclease activity lie in the polymerase domain of the protein. Therefore, study of structural data of the polymerase domain with respect to nucleic acid recognition provides one method of locating amino acids that, when altered, alter RNA recognition in a 5' nuclease reaction. For example, analysis conducted during the development of the present invention examined published analyses relating to primer/template binding by the polymerase domain of E. coli Pol 1, the Klenow fragment Table 1 shows a sampling of kinetic constants determined for the Klenow fragment, and shows the effects a number of mutations on these measurements. The corresponding or similarly positioned amino acids in the TaqPol are indicated in the right hand column. It was postulated that mutations having a noticeable impact on the interactions of the Klenow fragment with the DNA template or the primer/template duplex, as indicated by changes in $K_d$ and Relative DNA affinity values, might also have effects when made at the corresponding sites in TaqPol and related chimerical or mutant derivatives. A selection of the mutations that produced a higher $K_d$ value or a lower Relative DNA affinity value when introduced into the Klenow fragment were created and examined in TaqPol. These Taq derivatives include, but are not limited to, those indicated by asterisks in the right hand column of Table 1.

For some Klenow variants, such as the R682 mutants, selection for testing was not made based on the DNA amity measurements, but because molecular modeling suggested interaction between some aspect of the template/primer duplex and that amino acid. Similarly, additional regions of Taq polymerase (or Taq derivatives) were targeted for mutagenesis based on structural data and information from molecular modeling. Based on modeling, the thumb region was postulated to contact an RNA template. Thus, amino acids in the thumb region were looked for that, if altered, might alter that contact. For example, FIGS. 6 and 17 show that amino acids 502, 504, and 507 are located at the tip of the thumb. It was postulated that altering these amino acids might have an affect on the enzyme-substrate interaction. Using the activity screening methods described In Example 1, mutations that produced beneficial effects were identified. This approach was used to create a number of improved enzymes. For example, TaqPol position H784, corresponding to Klenow amino acid H881, is an amino acid in the fingers region and, as such, may be involved in primer/template substrate binding. When the H881 amino acid in the Klenow enzyme is replaced by alanine, the change decreases the affinity of the enzyme for DNA to only 30 to 40% of the wild type level. An analogous substitution was tested in a TaqPol-derived enzyme. Starting with the Taq derivative W417L/G418K/E507Q, amino acid 784 was changed from Histidine (H) to Alanine (A) to yield the W417L/G418K/E507Q/H784A mutant, termed Taq 4M. This variant showed improved 5' nuclease activity on the RNA test IrT1 (FIG. 24) test substrate (data in Table 2). Amino acid R587 is in the thumb region, and was selected for mutation based on its close proximity to the primer/template duplex in computer models. When an R587A mutation was added to the Taq 4M variant, the activity on the test IrT1 test substrate was still further improved. In addition, the reduction, relative to the 4M variant, in cleavage of the X structure shown in FIG. 22 constitutes an additional improvement in this enzyme's function.

Not all amino acid changes that reduce DNA binding in the polymerization affect the 5' nuclease activity. For example, mutations E615A, R677A, affecting amino acid that are also in the thumb and fingers domains, respectively, have either adverse effect, or no effect on the 5' nuclease activities, respectively, as measured using the test substrates in FIGS. 21 and 22, and compared to the parent variants that lacked these changes. The R677A mutation was added to, and compared with the TaqSS variant, while the E615A mutation was added to and compared with the Taq 4M variant. The test methods described herein provide a convenient means of analyzing any variant for the alterations in the cleavage activity of both invasive an noninvasive substrates, for both DNA and RNA containing structures. Thus, the present invention provides methods for identifying all suitable improved enzymes.

Alterations that might increase the affinity of the enzymes for the nucleic acid targets were also examined. Many of the mutations described above were selected because they caused the Klenow fragment enzyme to have decreased affinity for DNA, with the goal of creating enzymes more accepting of structures containing non-DNA strands. In general, the native DNA polymerases show a lower affinity for RNA/DNA duplexes, compared to their affinity for DNA/DNA duplexes. During the development of the present invention, it was sought to increase the general affinity of the proteins of the present invention for a nucleic acid substrate without restoring or increasing any preference for structures having DNA rather than RNA target strands. The substitution of amino acids having different charges was examined as a means of altering the interaction between the proteins and the nucleic acid substrates. For example, it was postulated that addition of positively charged amino acid residues, such as lysine (K), might increase the affinity of a protein for a negatively charged nucleic acid.

As noted above, alterations in the thumb region could affect the interactions of the protein with the nucleic acid substrate. In one example, the mutation G504K (tip of the thumb) was introduced in Taq4M and caused and enhancement of nuclease activity by 15% on an RNA target. Additional positively charged mutations (A502K and E507K) further improve the RNA target dependent activity by 50% compared to the parent Taq4M enzyme.

The use of data from published studies and molecular modeling, in combination with results accrued during the development of the present invention allowed the identification of regions of the proteins in which changes of amino acids would be likely to cause observable differences in at least one aspect of cleavage function. While regions could be targeted in this way, it was observed that changes in different amino acids, even if near or immediate neighbors in the protein, could have different effects. For example, while the A502K substitution created a marked increase in the RNA-dependent cleavage activity of Taq 4M, changing amino acid 499 from G to a K, only 3 amino acids away from 502, gave minimal improvement. As can be seen in the Experimental Examples, the approach of the present invention was to change several amino acids in a candidate region, either alone or in combination, then use the screening method provided in Example 1 to rapidly assess the effects of the changes. In this way, the rational design approach is easily applied to the task of protein engineering.

In addition to the thumb, palm, and hand regions found in the polymerase domain of these proteins, regions that are specific to 5' nucleases and nuclease domains were examined. Comparative studies on a variety of 5' nucleases have shown that, though the amino acid sequences vary dramatically from enzyme to enzyme, there are structural features common to most. Two of these features are the helix-hairpin-helix motif (H-h-H) and the arch or loop structure. The H-h-H motif is believed to mediate non-sequence specific DNA binding. It has been found in at least 14 families of proteins, including nucleases, N-glycosylases, ligases, helicases, topoisomerases, and polymerases (Doherty et al., Nucl. Acid. Res., 24:2488 [1996]). The crystallographic structure of rat DNA polymerase pol β bound to a DNA template-primer shows non-specific hydrogen bonds between the backbone nitrogens of the pol β HhH motif and the phosphate oxygens of the primer of the DNA duplex (Pelletier et al., Science 264:1891 [1994]). Because the HhH domain of 5' nuclease domains of Taq and Tth polymerases may function in a similar manner, it is contemplated that mutations in the HhH region of the enzyme alter activity. Mutations may be introduced to alter the shape and structure of the motif, or to change the charge of the motif to cause increased or decreased affinity for substrate.

Another structure common to many 5' nucleases from diverse sources such as eukaryotes, eubacteria, archaea and phage, is the arch or loop domain. The crystal structure of the 5' exonuclease of bacteriophage T5 showed a distinct arch formed by two helices, one positively charged and one containing hydrophobic residues (Ceska et al., Nature 382:90 [1996]). Interestingly, three residues that are conserved between T5 and Taq, Lys 83, Arg 86 and Tyr 82 are all in the arch. These correspond to amino acids Lys 83, Arg 86, and Tyr 82 in Taq DNA polymerase. The crystal structure for Taq (5' nuclease) has also been determined (Kim et al., Nature 376:612 [1995]).

The crystal structure from the flap endonuclease-1 from *Methanococcus janneschii* also shows such a loop motif (Hwang et al., Nat. Struct. Biol., 5:707 [1998]). The backbone crystal structure of Mja FEN-1 molecules may be superimposed on T5 exonuclease, Taq 5'-exonuclease and T4 RNase H. An interesting feature common to all of these is the long loop. The loop of FEN-1 consists of a number of positively charged and aromatic residues and forms a hole with dimensions large enough to accommodate a single-stranded DNA molecule. The corresponding region in T5 exonuclease consists of three helices forming a helical arch. The size of the hole formed by the helical arch in T5 exonuclease is less than half that formed by the L1 loop in Mj FEN-1. In T4 RNase H or Taq 5' exonuclease, this region is disordered. Some regions of the arch bind metals, while other regions of the arch contact nucleic acid substrate. Alignment of the amino-acid sequences of six 5' nuclease domains from DNA polymerases in the pol I family show six highly conserved sequence motifs containing ten conserved acidic residues (Kim et al., Nature 376 [1995]).

The effects of alterations in the arch region were examined. In Taq polymerase the arch region is formed by amino acids 80–95 and 96–109. Site-directed mutagenesis was performed on the arch region. Alignment of amino acid sequences of the FEN and polymerase 5' nucleases suggested the design of 3 amino acid substitution mutations, P88E, P90E and G80E. These substitutions were made on the Taq4M polymerase mutant as a parent enzyme. Results indicated that although the background activity on the HP and X substrates shown in FIG. 22 are tremendously suppressed in all mutants, the desirable 5' nuclease activity on proper substrates (IdT and IrT, FIG. 24) is also reduced. Despite the sequence homology between Taq and Tth polymerases, they have very different activity on HP and X substrates. The alignment of the Taq and Tth polymerase arch regions also demonstrates regions of extensive sequence homology as well as minor differences. These differences led to the design of mutations L109F and A110T using Taq4M to generate Taq4M L109F/A110T, and the mutant Taq 4M A502K/G504K/E507K/T514S to generate Taq 4M L109F/A110T/A502K/G504K/E507K/T514S mutant. These two mutations have drastically converted Taq4M enzyme to become more like Tth enzyme in terms of the background substrate specificity while the 5' nuclease activities on both DNA and RNA substrates are almost unchanged.

IV) Focused Random Mutagenesis

As described above, physical studies and molecular modeling may be used alone or in combination to identify regions of the enzymes in which changes of amino acids are likely to cause observable differences in at least one aspect of cleavage function. In the section above, use of this information was described to select and change specific amino acids or combinations of amino acids. Another method of generating an enzyme with altered function is to introduce mutations randomly. Such mutations can be introduced by a number of methods known in the art, including but not limited to, PCR amplification under conditions that favor nucleotide misincorporation (REF), amplification using primers having regions of degeneracy (i.e., base positions in which different individual, but otherwise similar oligonucleotides in a reaction may have different bases), and chemical synthesis. Many methods of random mutagenesis are known in the art (Del Rio et al., Biotechniques 17:1132 [1994]), and may be incorporated into the production of the enzymes of the present invention. The discussions of any particular means of mutagenesis contained herein are presented solely by way of example and not intended as a limtation. When random mutagenesis is performed such that only a particular region of an entire protein is varied, it can be described as "focused random mutagenesis." As described in the Experimental Examples, a focused random mutagenesis approach was applied to vary the HhH and the thumb domains some of the enzyme variants previously created. These domains were chosen to provide examples of this approach, and it is not intended that the random mutagenesis approach be limited to any particular domain, or to a single domain. It may be applied to any domain, or to any entire protein. Proteins thus modified were tested for cleavage activity in the screening reactions described in Example 1, using the test substrates diagrammed in FIGS. 22 and 24, with the results described in Tables 5 and 6.

Random mutagenesis was performed on the HhH region with the parent TaqSS or TthDN H785A mutants. None of the 8 mutants generated showed an improvement in activity compared to the parent enzyme (Table 5). In fact, mutations of the region between residues 198–205 have about 2–5 fold lower activity on both DNA and RNA substrates, suggesting that this region is essential for substrate recognition. Mutagenesis in the thumb region resulted in new mutations that improved 5' nuclease activity by 20–100% on a DNA target and about 10% on an RNA target (Table 6).

Numerous amino acids in each of the distinct subdomains play roles in substrate contact. Mutagenesis of these may alter substrate specificity by altering substrate binding. Moreover, mutations introduced in amino acids that do not directly contact the substrate may also alter substrate specificity through longer range or general conformation altering effects. These mutations may be introduced by any of several methods known in the art, including, but not limited to random mutagenesis, site directed mutageness, and generation of chimeric proteins.

As noted above, numerous methods of random mutagenesis are known in the art. The methods applied in the focused random mutagenesis described herein my be applied to whole genes. It is also contemplated that additional useful chimerical constructs may be created through the use of molecular breeding (See e g., U.S. Pat. No. 5,837,458 and PCT Publications WO 00/18906, WO 99/65927, WO 98/31837, and WO 98/27230, herein incorporated by reference in their entireties). Regardless of the mutagenesis method chosen, the rapid screening method described herein provides a fast and effective means of identifying beneficial changes within a large collection of recombinant molecules. This makes the random mutagenesis procedure a manageable and practical tool for creating a large collection of altered 5' nucleases having beneficial improvements. The cloning and mutagenesis strategies employed for the enzymes used as examples are applicable to other thermostable and non-thermostable Type A polymerases, since DNA sequence similarity among these enzymes is very high. Those skilled in the art would understand that differences in sequence would necessitate differences in cloning strategies, for example, the use of different restriction endonucleases may be required to generate chimeras. Selection of existing alternative sites, or introduction via mutagenesis of alternative sites are well established processes and are known to one skilled in the art.

Enzyme expression and purification can be accomplished by a variety of molecular biology methods. The examples described below teach one such method, though it is to be understood that the present invention is not to be limited by the method of cloning, protein expression, or purification. The present invention contemplates that the nucleic acid construct be capable of expression in a suitable host. Numerous methods are available for attaching various promoters and 3' sequences to a gene structure to achieve efficient expression.

Experimental

The following examples serve to illustrate certain preferred embodiments and aspects of the present invention and are not to be construed as limiting the scope thereof.

In the disclosure which follows, the following abbreviations apply: Afu (*Archaeoglobus fulgidus*); Mth (*Methanobacterium thermoautotrophicum*); Mja (*Methanococcus jannaschii*); Pfu (*Pyrococcus furiosus*); Pwo (*Pyrococcus woesei*); Taq (*Thermus aquaticus*); TaqPol (*T. aquaticus* DNA polymerase I); StfPol (the Stoffel fragment of TaqPol); Ec1Pol (*E. coli* DNA polymerase I); Tth (*Thermus thermophilus*); TthPol (*T. thermophilus* DNA polymerase I); Tsc (*Thermus scotoductus*); TscPol (*Thermus scotoductus* DNA polymerase I); Tfi (*Thermus filiformis*); TfiPol (*Thermus filiformis* DNA polymerase I); Ex. (Example); Fig. (Figure); ° C. (degrees Centigrade); g (gravitational field); vol (volume); w/v (weight to volume); v/v (volume to volume); BSA (bovine serum albumin); CTAB (cetyltrimethylammonium bromide); HPLC (high pressure liquid chromatography); DNA (deoxyribonucleic acid); p (plasmid); $\mu$l (microliters); ml (milliliters); $\mu$g (micrograms); pmoles (picomoles); mg (milligrams); M (molar); mM (milliMolar); $\mu$M (microMolar); nm (nanometers); kdal (kilodaltons); OD (optical density); EDTA (ethylene diamine tetra-acetic acid); FITC (fluorescein isothiocyanate); SDS (sodium dodecyl sulfate); $NAPO_4$ (sodium phosphate); Tris (tris(hydroxymethyl)-aminomethane); PMSF phenylmethylsulfonylfluoride); TAE (Tris-acetate-EDTA, i.e., 40 mM Tris-Acetate, 1 mM EDTA); TBE (Tris-Borate-EDTA, i.e., Tris buffer titrated with boric acid rather than HCl and containing EDTA); PBS (phosphate buffered saline); PPBS (phosphate buffered saline containing 1 mM PMSF); PAGE (polyacrylamide gel electrophoresis); Tween (polyoxyethylene-sorbitan); ATCC (American Type Culture Collection, Rockville, Md.); DSMZ (Deutsche Sammlung von Mikroorganismen und Zellculturen, Braunschweig, Germany); Sigma (Sigma Chemical Company, St. Louis, Mo.); Dynal (Dynal A. S., Oslo, Norway); Gull (Gull Laboratories, Salt Lake City, Utah); Epicentre (Epicentre Technologies, Madison, Wis.); MJ Research (MJ Research, Watertown, Mass.); National Biosciences (Plymouth, Minn.); New England Biolabs (Beverly, Mass.); Novagen (Novagen, Inc., Madison, Wis.); Perlin Elmer Norwalk, Conn.); Promega Corp. (Madison, Wis.); Stratagene (Stratagene Cloning Systems, La Jolla, Calif.); Clonetech (Clonetech, Palo Alto, Calif.); Pharmacia (Pharmacia, Piscataway, N.J.); Milton Roy (Milton Roy, Rochester, N.Y.); Amersham (Amersham International, Chicago, Ill.); USB (U.S. Biochemical, Cleveland, Ohio); and Qiagen (Valencia, Calif.).

EXAMPLE 1

Rapid Screening of Colonies for 5' Nuclease Activity

Figure 18A:
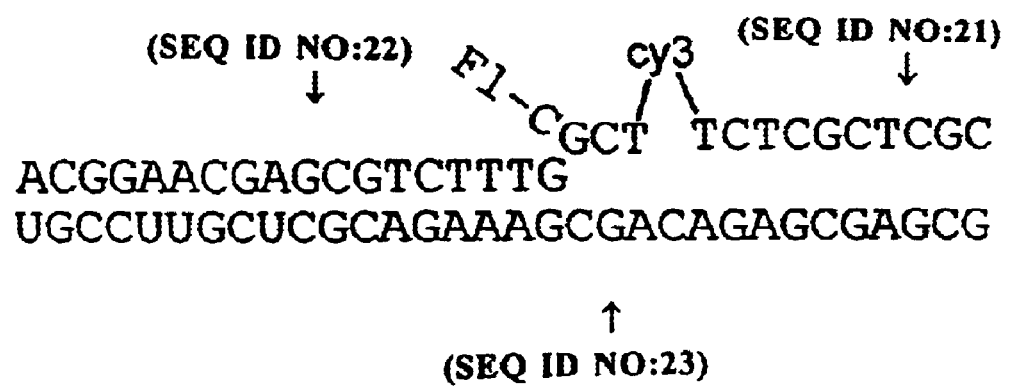
FIGS. 18 A–D show schematic diagrams of examples of substrates that may be used to measure various cleavage activities of enzymes. The substrates may be labeled, for example, with a fluorescent dye and a quenching moiety for FRET detection, as shown, to facilitate detection and measurement. The substrates of 18A and 18B are invasive cleavage structures having RNA and DNA target strands, respectively. 18C shows an example of an X-structure, and 18D shows an example of a hairpin structure, both of which may be used to assess the activity of enzymes on alternative structures that may be present in invasive cleavage reactions.
Figure 18B:
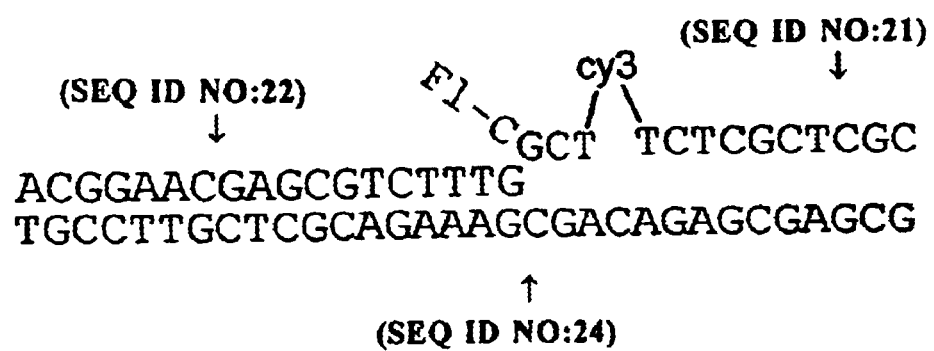
Figure 18C:
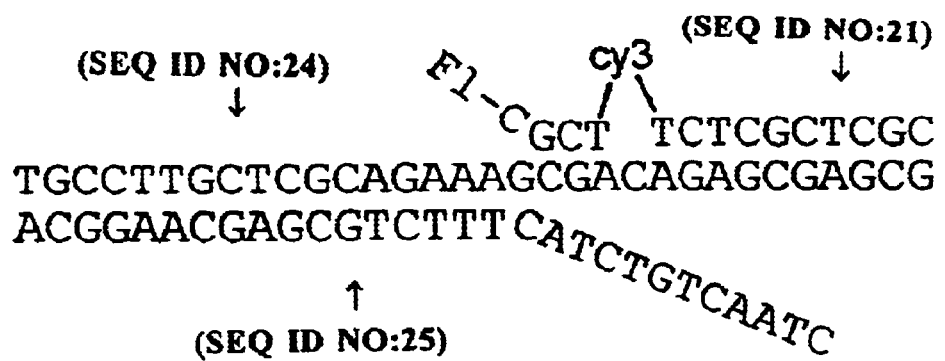
Figure 18D:
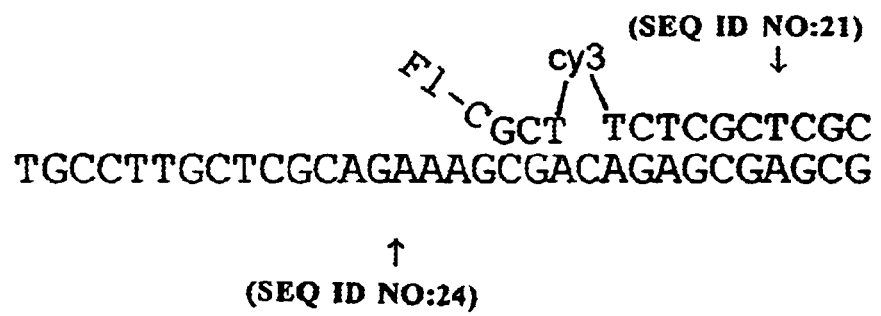

The native 5' nucleases and the enzymes of the present invention can be tested directly for a variety of functions. These include, but are not limited to, 5' nuclease activity on RNA or DNA targets and background specificity using alternative substrates representing structures that may be present in a target detection reaction. Examples of nucleic acid molecules having suitable test structures are shown schematically in FIGS. 18A–D and FIGS. 21–24. The screening techniques described below were developed to quickly and efficiently characterize 5' nucleases and to determine whether the new 5' nucleases have any improved or desired activities. Enzymes that show improved cycling rates on RNA or DNA targets, or that result in reduced target-independent cleavage merit more thorough investigation. In general, the modified proteins developed by random mutagenesis were tested by rapid colony screen on the substrates shown in FIGS. 18A and 18B. A rapid protein extraction was then done, and a test of activity on alternative structures, (e.g., as shown in FIGS. 18C–D) was performed using the protein extract. Either the initial screen, or further screening and characterization of enzymes for improved activity may be performed using other cleavage complexes, such as those diagrammed in FIGS. 21–24. It is not intended that the scope of the invention be limited by the particular sequences used to form such test cleavage structures. One skilled in the art would understand how to design and create comparable nucleic acids to form analogous structures for rapid screening.

This order of testing may be chosen to reduce the number of tests overall, to save time and reagents. The order of testing for enzyme function is not intended to be a limitation on the present invention. Those mutants that showed reasonable cycling rates with the RNA or DNA targets may then be cultured overnight, and a rapid protein extraction done. Alternatively, any subset or all of the cleavage tests may be done at the same time.

For convenience, each type of rapid screen may be done on a separate microtiter plate. For example, one plate may be set up to test RNA INVADER activity, one plate set up to test for DNA INVADER activity. As many as 90 different colonies may be screened on one plate. The colonies screened can be from a variety of sources, such as clones of unaltered (native) 5' nucleases, from one mutagenesis reaction (e.g., many colonies from a single plate) or from a variety of reactions (colonies selected from multiple plates).

Ideally, positive and negative controls should be run on the same plate as the mutants, using the same preparation of reagents. One example of a good positive control is a colony containing the unmodified enzyme, or a previously modified enzyme whose activity is to be compared to new mutants.

For example, if a mutagenesis reaction is performed on the Taq DN RX HT construct (described below), the unmodified Taq DN RX HT construct would be chosen as the standard for comparing the effects of mutagenesis on enzymatic activity. Additional control enzymes may also be incorporated into the rapid screening test. For example, Tth DN RX HT (described below; unless otherwise specified, the TaqPol and TthPol enzymes of the following discussion refer to the DN RX HT derivative) may also be included as a standard for enzymatic activity along with the Taq DN RX HT. This would allow a comparison of any altered enzymes to two known enzymes having different activities. A negative control should also be run to determine the background reaction levels (i.e., cleavage or probe degradation due to sources other than the nucleases being compared). A good negative control colony would be one containing only the vector used in the cloning and mutagenesis, for example, colonies containing only the pTrc99A vector.

Two factors that may influence the number of colonies chosen from a specific mutagenesis reaction for the initial rapid screen are 1) total number of colonies obtained from the mutagenesis reaction, and 2) whether the mutagenesis reaction was site-specific or randomly distributed across a whole gene or a region of a gene. For example, if only 5–10 colonies are present on the plate, all colonies can easily be tested. If hundreds of colonies are present, a subset of these may be analyzed. Generally 10–20 colonies are tested from a site-specific mutagenesis reaction, while 80 to 100 or more colonies are routinely tested from a single random mutagenesis reaction.

Where indicated, the altered 5' nucleases described in these experimental examples were tested as detailed below.

A. Rapid screen: INVADER Activity on RNA Target (FIG. 18A)

A 2×substrate mix was prepared, comprising 20 mM MOPS, pH 7.5, 10 mM MgSO$_4$, 200 mM KCl, 2 μM FRET-probe oligo SEQ ID NO:21 (5'-Fl-CGCT-cy3-TCTCGCTCGC-3'), 1 μM INVADER oligo SEQ ID NO:22 (5'-ACGGAACGAGCGTCTTTG-3'), and 4 nM RNA target SEQ ID NO:23 (5'-GCG AGC GAGA CAG CGA AAG ACG CUC GUU CCG U-3'). Five μl of the 2×substrate mix were dispensed into each sample well of a 96 well microtiter plate (Low Profile MULTIPLATE 96, M.J. Research, Inc.).

Cell suspensions were prepared by picking single colonies (mutants, positive control, and negative control colonies) and suspending each one in 20 μl of water. This can be done conveniently in a 96 well microtiter plate format, using one well per colony.

Five μl of the cell suspension was added to the appropriate test well such that the final reaction conditions were 10 mM MOPS, pH 7.5, 5 mM MgSO$_4$, 100 mM KCl, 1 μM FRET-probe oligo, 0.5 μM INVADER oligo, and 2 nM RNA target. The wells were covered with 10 μl of Clear Chill-out 14 (M.J. Research, Inc.) liquid wax, and the samples were heated at 85° C. for 3 minutes, then incubated at 59° C. for 1 hour. After the incubation, the plates were read on a Cytofluor flourescense plate reader using the following parameters: excitation 485/20, emission 530/30.

B. Rapid Screen: INVADER Activity on DNA Target (FIG. 18B)

A 2×substrate mix was prepared, comprising 20 mM MOPS, pH 7.5, 10 mM MgSO$_4$, 200 mM KCl, 2 μM FRET-probe oligo SEQ ID NO:21 (5'-Fl-CGCT-Cy3-TCTCGCTCGC-3'), 1 μM INVADER oligo SEQ ID NO:22 (5'-ACGGAACGAGCGTCTTTG-3'), 1 nM DNA target SEQ ID NO:24 (5'-GCG AGC GAGA CAG CGA AAG ACG CTC GTT CCG T-3'). Five μl of the 2×substrate mix was dispensed into each sample well of a 96 well microtiter plate (MJ Low Profile).

Cell suspensions were prepared by picking single colonies (mutants, positive control and negative control colonies) and suspending them in 20 μl of water, generally in a 96 well microtiter plate format.

5 μl of the cell suspension were added to the appropriate test well such that the final reaction conditions were 10 mM MOPS, pH 7.5, 5 mM MgSO$_4$, 100 mM KCl, 1 μM FRET-probe oligo, 0.5 μM INVADER oligo, and 0.5 nM DNA target. Wells were covered with 10 μl of Clear Chill-out 14 (M.J. Research, Inc.) liquid wax, and the reactions were heated at 85° C. for 3 minutes, then incubated at 59° C. for 1 hour. After the hour incubation, the plate were read on a Cytofluor flourescan plate reader using the following parameters: excitation 485/20, emission 530/30, gain 40, reads per well 10.

C. Rapid Protein Extraction (Crude Cell Lysate)

Those mutants that gave a positive or an unexpected result in either the RNA or DNA INVADER assay were further analyzed, specifically for background activity on the X-structure or the hairpin substrate (FIGS. 18C and D, respectively). A rapid colony screen format can be employed, as described above. By simply changing the substrate, tests for background or aberrant enzymatic activity can be done. Another approach would be to do a rapid protein extraction from a small overnight culture of positive clones, and then test this crude cell lysate for additional protein function. One possible rapid protein extraction procedure is detailed below. Two to five ml of LB (containing the appropriate antibiotic for plasmid selection; See e.g., Maniatis, books 1,2 and 3) were inoculated with the remaining volume of the 20 μl water-cell suspension and incubated at 37° C. overnight. About 1.4 ml of the culture were transferred to a 1.5 ml microcentrifuge tube, and microcentrifuged at top speed (e.g., 14,000 rpm in an Eppendorf 5417 table top microcentrifuge), at room temperature for 3–5 minutes to pellet the cells. The supernatant was removed, and the cell pellet was suspended in 100 μl of TES buffer pH 7.5 (Sigma). Lysozyme (Promega) was added to a final concentration of 0.5 μg/μl and samples were incubated at room temperature for 30 minutes. Samples were then heated at 70° C. for 10 minutes to inactivate the lysozyme, and the cell debris was pelleted by microcentrifugation at top speed for 5 minutes. The supernatant was removed and this crude cell lysate was used in the following enzymatic activity assays.

D. Rapid Screen: Background Specificity X Structure Substrate (FIG. 18C)

Reactions were performed under conditions as detailed above. One μl of crude cell lysate was added to 9 μl of reaction components for a final volume of 10 μl and final concentrations of 10 mM MOPS, pH 7.5, 5 mM MgSO$_4$, 100 mM KCl, 1 μM FRET-probe oligo (SEQ ID NO:21), 0.5 μM X-structure INVADER oligo SEQ ID NO:25 (5'-ACGGAACGAGCGTCTTTCATCTGTCAATC-3'), and 0.5 nM DNA target (SEQ ID NO:24). Wells were covered with 10 μl of Clear Chill-out 14 (M.J. Research, Inc.) liquid wax, and the reactions were heated at 85° C. for 3 minutes, then incubated at 59° C. for 1 hour. After the incubation, the plates were read on a Cytofluor fluorescence plate reader using the following parameters: excitation 485/20, emission 530/30, gain 40, reads per well 10.

E. Rapid Screen: Background Specificity Hairpin Substrate (FIG. 18D)

Reactions were performed under conditions as detailed above. One μl of crude cell lysate was added to 9 μl of reaction components for a final volume of 10 µl and final concentrations of 10 mM MOPS, pH 7.5, 5 mM MgSO$_4$, 100 mM KCl, 1 µM FRET-probe oligonucleotide (SEQ ID NO:21), and 0.5 nM DNA target (SEQ ID NO:24). Wells were covered with 10 µl of Clear Chill-out 14 (M.J. Research, Inc.) liquid wax, and the reactions were heated at 85° C. for 3 minutes, then incubated at 59° C. for 1 hour. After the hour incubation, the plate were read on a Cytofluor plate reader using the following parameters: excitation 485/20, emission 530/30, gain 40, reads per well 10.

F. Activity Assays with IrT1 and IdT targets (FIGS. 24)

The 5' nuclease activities assays were carried out in 10 µl of a reaction containing 10 mM MOPS, pH 7.5, 0.05% Tween 20, 0.05% Nonidet P-40, 10 µg/ml tRNA, 100 mM KCl and 5 mM MgSO$_4$. The probe concentration (SEQ ID NO: 26) was 2 mM. The substrates (IrT1 (SEQ ID NO: 35) or IdT (SEQ ID NO: 36) at 10 or 1 nM final concentration respectively) and approximately 20 ng of an enzyme, prepared as in Example 3, were mixed with the above reaction buffer and overlaid with Chill-out (MJ Research) liquid wax. Reactions were brought up to reaction temperature 57° C., started by addition of MgSO$_4$, and incubated for 10 min. Reactions were then stopped by the addition of 10 µl of 95% formamide containing 10 mM EDTA and 0.02% methyl violet (Sigma). Samples were heated to 90° C. for 1 minute immediately before electrophoresis through a 20% denaturing acrylamide gel (19:1 cross-linked), with 7 M urea, and in a buffer of 45 mM Tris-borate, pH 8.3, 1.4 mM EDTA. Unless otherwise indicated, 1 µl of each stopped reaction was loaded per lane. Gels were then scanned on an FMBIO-100 fluorescent gel scanner (Hitachi) using a 505 nm filter. The fraction of cleaved product was determined from intensities of bands corresponding to uncut and cut substrate with FMBIO Analysis software (version 6.0, Hitachi). The fraction of cleavage product did not exceed 20% to ensure that measurements approximated initial cleavage rates. The turnover rate was defined as the number of cleaved signal probes generated per target molecule per minute under these reaction conditions (1/min).

G. Activity Assays with X Structure (X) and Hairpin (BP) Targets (FIG. 22)

The 5' nuclease activity assays were carried out in 10 µl of a reaction containing 10 mM MOPS, pH 7.5, 0.05% Tween 20, 0.05% Nonidet P-40, 10 µg/ml tRNA, 100 mM KCl and 5 mM MgSO$_4$. Each oligo for formation of either the hairpin structure assembly (22A, SEQ ID NOS: 29 and 30) assembly or the X structure assembly (22B, SEQ ID NOS: 29–31) was added to a final concentration of 1 µm, and approximately 20 ng of test enzyme prepared as described in Example 3, were mixed with the above reaction buffer and overlaid with Chill-out (MJ Research) liquid wax. Reactions were brought up to reaction temperature 60° C., started by addition of MgSO$_4$, and incubated for 10 min. Reactions were then stopped by the addition of 10 µl of 95% formamide containing 10 mM EDTA and 0.02% methyl violet (Sigma). Samples were heated to 90° C. for 1 minute immediately before electrophoresis through a 20% denaturing acrylamide gel (19:1 cross-linked), with 7 M urea, and in a buffer of 45 mM Tris-borate, pH 8.3, 1.4 mM EDTA. Unless otherwise indicated, 1 µl of each stopped reaction was loaded per lane. Gels were then scanned on an FMBIO-100 fluorescent gel scanner (Hitachi) using a 505 nm filter. The fraction of cleaved product was determined from intensities of bands corresponding to uncut and cut substrate with FMBIO Analysis software (version 6.0, Hitachi). The fraction of cleavage product did not exceed 20% to ensure that measurements approximated initial cleavage rates. The turnover rate was defined as the number of cleaved signal probes generated per target molecule per minute under these reaction conditions (1/min).

H. Activity Assays with Human IL-6 Target (FIG. 10)

The 5' nuclease activities assays were carried out in 10 µl reactions containing 10 mM MOPS, pH 7.5, 0.05% Tween 20, 0.05% Nonidet P-40, 10 µg/ml tRNA, 100 mM KCl and 5 mM MgSO$_4$. Reactions comprising the DNA IL-6 substrate contained 0.05 nM IL-6 DNA target (SEQ ID NO: 18) and 1 µM of each probe (SEQ ID NO: 16) and INVADER (SEQ ID NO: 15) oligonucleotides, and were carried out at 60° C. for 30 min. Reactions comprising the IL-6 RNA target (SEQ ID NO: 17) were performed under the same conditions, except that the IL-6 RNA target concentration was 1 nM and the reactions were performed at 57° C. for 60 min. Each reaction contained approximately 20 ng of test enzyme, prepared as described in Example 3.

Figure 23:
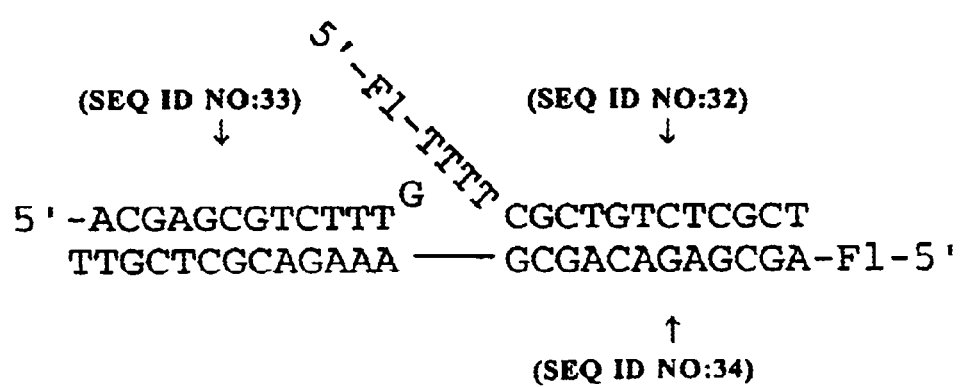
FIG. 23 shows a schematic diagram for a model substrate used to test enzymes for invasive cleavage activity.

I. Activity Assays with Synthetic r25mer Target (FIG. 23)

Reactions comprising the synthetic r25mer target (SEQ ID NO: 34) were carried out under the same reaction conditions (10 mM MOPS, pH 7.5, 0.05% Tween 20, 0.05% Nonidet P-40, 10 µg/ml tRNA, 100 mM KCl and 5 mM MgSO$_4$) and 1 µM of each probe (SEQ ID NO: 32) and INVADER (SEQ ID NO: 33) oligonucleotides, except that the r25mer target concentration was 5 nM and the reactions were performed at 58° C. for 60 min. Approximately 20 ng of each test enzyme was added to the reactions. Enzymes were prepared as described in Example 3.

Any of the tests described above can be modified to derive the optimal conditions for enzymatic activity. For example, enzyme titrations can be done to determine the optimal enzyme concentration for maximum cleavage activity, and lowest background signal. By way of example, but not by way of limitation, many of the mutant enzymes were tested at 10, 20 and 40 ng amounts. Similarly, a temperature titration can also be incorporated into the tests. Since modifying the structure of a protein can alter its temperature requirements, a range of temperatures can be tested to identify the condition best suited for the mutant in question.

Examples of the results from such screens (using approximately 20 ng of the mutant enzyme) are shown in Tables 2–7, and FIGS. 12, 14, 15, 19, and 25.

EXAMPLE 2

Cloning and Expression of 5' Nucleases of DNA polymerases and Mutant Polymerases A. DNA Polymerases of *Thermus aquaticus* and *Thermus thermophilus*

1. Cloning of TaqPol and TthPol

Type A DNA polymerases from eubacteria of the genus Thermus share extensive protein sequence identity (90% in the polymerization domain, using the Lipman-Pearson method in the DNA analysis software from DNAStar, WI) and behave similarly in both polymerization and nuclease assays. Therefore, the genes for the DNA polymerase of *Thermus aquaticus* (TaqPol), *Thermus thermophilus* (TthPol) and *Thermus scotoductus* were used as representatives of this class. Polymerase genes from other eubacterial organisms, including, but not limited to, *Escherichia coli, Streptococcus pneumoniae, Mycobacterium smegmatis, Thermus thermophilus*, Thermus sp., *Thermotoga maritima, Thermosipho africanus*, and *Bacillus stearothermophilus* are equally suitable.

a. Initial TaqPol Isolation: Mutant TaqA/G

The Taq DNA polymerase gene was amplified by polymerase chain reaction from genomic DNA from *Thermus aquaticus*, strain YT-1 (Lawyer et al., supra), using as primers the oligonucleotides described in SEQ ID NOS:37 and 38. The resulting fragment of DNA has a recognition sequence for the restriction endonuclease EcoRI at the 5' end of the coding sequence and a BglII sequence at the 3' end of the coding strand. Cleavage with BglII leaves a 5' overhang or "sticky end" that is compatible with the end generated by BamHI. The PCR-amplified DNA was digested with EcoRI and BamHI. The 2512 bp fragment containing the coding region for the polymerase gene was gel purified and then ligated into a plasmid that contains an inducible promoter.

In one embodiment of the invention, the pTTQ18 vector, which contains the hybrid trp-lac (tac) promoter, was used (M.J.R. Stark, Gene 5:255 [1987]). The tac promoter is under the control of the *E. coli* lac repressor protein. Repression allows the synthesis of the gene product to be suppressed until the desired level of bacterial growth has been achieved, at which point repression is removed by addition of a specific inducer, isopropyl-b-D-thiogalactopyranoside (IPTG). Such a system allows the controlled expression of foreign proteins that may slow or prevent growth of transformants.

Particularly strong bacterial promoters, such as the synthetic Ptac, may not be adequately suppressed when present on a multiple copy plasmid. If a highly toxic protein is placed under control of such a promoter, the small amount of expression leaking through, even in the absence of an inducer, can be harmful to the bacteria. In another embodiment of the invention, another option for repressing synthesis of a cloned gene product is contemplated. A non-bacterial promoter from bacteriophage T7, found in the plasmid vector series pET-3, was used to express the cloned mutant Taq polymerase genes (Studier and Moffatt, J. Mol. Biol., 189:113 [1986]). This promoter initiates transcription only by T7 RNA polymerase. In a suitable strain, such as BL21 (DE3)pLYS, the gene for the phage T7 RNA polymerase is carried on the bacterial genome under control of the lac operator. This arrangement has the advantage that expression of the multiple copy gene (on the plasmid) is completely dependent on the expression of T7 RNA polymerase, which is easily suppressed because it is present in a single copy.

These are just two examples of vectors having suitable inducible promoters. Others are well known to those skilled in the art, and it is not intended that the improved nucleases of the present invention be limited by the choice of expression system.

For ligation into the pTTQ18 vector, the PCR product DNA containing the Taq polymerase coding region (termed mutTaq for reasons discussed below, SEQ ID NO:39) was digested with EcoRI and BglII and this fragment was ligated under standard "sticky end" conditions (Sambrook et al. *Molecular Cloning*, Cold Spring Harbor Laboratory Press, Cold Spring Harbor, pp. 1.63–1.69 [1989]) into the EcoRI and BamHI sites of the plasmid vector pTTQ18. Expression of this construct yields a translational fusion product in which the first two residues of the native protein (Met-Arg) are replaced by three from the vector (Met-Asn-Ser), but the remainder of the PCR product's protein sequence is not changed (SEQ ID NO:40). The construct was transformed into the JM109 strain of *E. coli*, and the transformants were plated under incompletely repressing conditions that do not permit growth of bacteria expressing the native protein. These plating conditions allow the isolation of genes containing pre-existing mutations, such as those that result from the infidelity of Taq polymerase during the amplification process.

Using this amplification/selection protocol, a clone was isolated containing a mutated Taq polymerase gene (mutTaq). The mutant was first detected by its phenotype, in which temperature-stable 5' nuclease activity in a crude cell extract was normal, but polymerization activity was almost absent (approximately less than 1% of wild type Taq polymerase activity). Polymerase activity was determined by primer extension reactions. The reactions were carried out in 10 μl of buffer containing 10 mM MOPS, pH 7.5, 5 mM MgSO$_4$, 100 mM KCl. In each reaction, 40 ng of enzyme were used to extend 10 μM (dT)$_{25-30}$ primer in the presence of either 10 μM poly (A)$_{286}$, or 1 μM poly (dA)$_{273}$ template, 45 μM dTTP and 5 μM Fl-dUTP at 60° C. for 30 minutes. Reactions were stopped with 10 μl of stop solution (95% formamide, 10 mM EDTA, 0.02% methyl violet dye). Samples (3 μl) were fractionated on a 15% denaturing acrylamide gel (19:1 crossed-linked) and the fraction of incorporated Fl-dUTP was quantitated using an FMBIO-100 fluorescence gel scanner (Hitachi) equipped with a 505 nm emission filter.

DNA sequence analysis of the recombinant gene showed that it had changes in the polymerase domain resulting in two amino acid substitutions: an A to G change at nucleotide position 1394, which causes a Glu to Gly change at amino acid position 465 (numbered according to the natural nucleic and amino acid sequences, SEQ ID NOS:1 and 4), and another A to G change at nucleotide position 2260, which causes a Gln to Arg change at amino acid position 754. Because the Gln to Gly mutation is at a nonconserved position and because the Glu to Arg mutation alters an amino acid that is conserved in virtually all of the known Type A polymerases, the latter mutation is most likely the one responsible for curtailing the synthesis activity of this protein. The nucleotide sequence for the construct is given in SEQ ID NO:39. The enzyme encoded by this sequence is referred to as Taq A/G.

b. Initial TthPol Isolation

The DNA polymerase enzyme from the bacterial species *Thermus thermophilus* (Tth) was produced by cloning the gene for this protein into an expression vector and overproducing it in *E. coli* cells. Genomic DNA was prepared from 1 vial of dried *Thermus thermophilus* strain HB-8 from ATCC (ATCC #27634). The DNA polymerase gene was amplified by PCR using the following primers: 5'-CACGAATTCCGAGGCGATGCTTCCGCTC-3' (SEQ ID NO:41) and 5'-TCGACGTCGACTAAC CCTTGGCGGAAAGCC-3' (SEQ ID NO:42). The resulting PCR product was digested with EcoRI and SalI restriction endonucleases and inserted into EcoRI/Sal I digested plasmid vector pTrc99G (described in Example 2C1) to create the plasmid pTrcTth-1. This Tth polymerase construct is missing a single nucleotide that was inadvertently omitted from the 5' oligonucleotide, resulting in the polymerase gene being out of frame. This mistake was corrected by site specific mutagenesis of pTrcTth-1 as described in Examples 4 and 5 using the following oligonucleotide: 5'-GCATCGCCTCGGAATTCATGGTC-3' (SEQ ID NO:43), to create the plasmid pTrcTth-2. The protein and the nucleic acid sequence encoding the protein are referred to as TthPol, and are listed as SEQ ID NOS:6 and 3 respectively.

C. Large Scale Preparation of Recombinant Proteins

The recombinant proteins were purified by the following technique which is derived from a Taq DNA polymerase preparation protocol (Engelke et al., Anal. Biochem., 191:396 [1990]) as follows. *E. coli* cells (strain JM109) containing either pTrc99A TaqPol, pTrc99GTthPol were inoculated into 3 ml of LB containing 100 mg/ml ampicillin and grown for 16 hrs at 37° C. The entire overnight culture was inoculated into 200 ml or 350 ml of LB containing 100 mg/ml ampicillin and grown at 37° C. with vigorous shaking to an $A_{600}$ of 0.8. IPTG (1 M stock solution) was added to a final concentration of 1 mM and growth was continued for 16 hrs at 37° C.

The induced cells were pelleted and the cell pellet was weighed. An equal volume of 2×DG buffer (100 mM Tris-HCl, pH 7.6, 0.1 mM EDTA) was added and the pellet was suspended by agitation. Fifty mg/ml lysozyme (Sigma) were added to 1 mg/ml final concentration and the cells incubated at room temperature for 15 min. Deoxycholic acid (10% solution) was added dropwise to a final concentration of 0.2% while vortexing. One volume of $H_2O$ and 1 volume of 2×DG buffer were added, and the resulting mixture was sonicated for 2 minutes on ice to reduce the viscosity of the mixture. After sonication, 3 M $(NH_4)_2SO_4$ was added to a final concentration of 0.2 M, and the lysate was centrifuged at 14000×g for 20 min at 4° C. The supernatant was removed and incubated at 70° C. for 60 min at which time 10% polyethylimine (PEI) was added to 0.25%. After incubation on ice for 30 min., the mixture was centrifuged at 14,000×g for 20 min at 4° C. At this point, the supernatant was removed and the protein precipitated by the addition of $(NH_4)_2SO_4$ as follows.

Two volumes of 3 M $(NH_4)_2SO_4$ were added to precipitate the protein. The mixture was incubated overnight at room temperature for 16 hrs centrifuged at 14,000×g for 20 min at 4° C. The protein pellet was suspended in 0.5 ml of Q buffer (50 mM Tris-HCl, pH 8.0, 0.1 mM EDTA, 0.1% Tween 20). For the Mja FEN-1 preparation, solid $(NH_4)_2SO_4$ was added to a final concentration of 3 M (~75% saturated), the mixture was incubated on ice for 30 min, and the protein was spun down and sanded as described above.

The suspended protein preparations were quantitated by determination of the $A_{279}$ dialyzed and stored in 50% glycerol, 20 mM Tris HCl, pH8.0, 50 mM KCl, 0.5% Tween 20, 0.5% Nonidet P-40, with 100 µg/ml BSA.

B. DNA Polymerases of *Thermus filiformis* and *Thermus scotoductus*

1. Cloning of *Thermus filiformis* and *Thermus scotoductus*

One vial of lyophilized *Thermus filiformis* (Tfi) obtained from DSMZ (Deutsche Sammlung von Mikroorganismen und Zellculturen, Braunschweig, Germany, strain #4687) was rehydrated in 1 ml of Castenholz medium (DSMZ medium 86) and inoculated into 500 ml of Castenholz medium preheated to 50° C. The culture was incubated at 70° C. with vigorous shaking for 48 hours. After growth, the cells were harvested by centrifugation at 8000×g for 10 minutes, the cell pellet was suspended in 10 ml of TE (10 mM TrisHCL, pH 8.0, 1 mM EDTA), and the cells were frozen at −20° C. in 1 ml aliquots. A 1 ml aliquot was thawed, lysozyme was added to 1 mg/ml, and the cells were incubated at 23° C. for 30 minutes. A solution of 20% SDS (sodium dodecyl sulfate) was added to a final concentration of 0.5% followed by extraction with buffered phenol. The aqueous phase was further extracted with 1:1 phenol:chloroform, and extracted a final time with chloroform. One-tenth volume of 3 M sodium acetate, pH 5.0 and 2.5 volumes of ethanol were added to the aqueous phase and mixed. The DNA was pelleted by centrifugation at 20,000×g for 5 minutes. The DNA pellet was washed with 70% ethanol, air dried and resuspended in 200 µl of TE and used directly for amplification. *Thermus scotodutus* (Tsc, ATCC #51532) was grown and genomic DNA was prepared as described above for *Thermus filiformis*.

The DNA polymerase I gene from Tfi (GenBank accession #AF030320) could not be amplified as a single fragment. Therefore, it was cloned in 2 separate fragments into the expression vector pTrc99a. The 2 fragments overlap and share a Not I site which was created by introducing a silent mutation at position 1308 of the Tfi DNA polymerase open reading frame (ORF) in the PCR oligonucleotides. The 3' half of the gene was amplified using the Advantage cDNA PCR kit (Clonetech) with the following oligonucleotides; 5'-ATAGCCATGGTGGAGCGGCCGCTCTCCCGG (SEQ ID NO:44) and 5'-AAGCGTCGACTCAAT CCTGCT-TCGCCTCCAGCC (SEQ ID NO:45). The PCR product from this reaction was approximately 1200 base pairs in length. It was cut with the restriction enzymes Not I and Sal I, and the resulting DNA was ligated into pTrc99a cut with NotI and SalI to create pTrc99a-Tfi3'. The 5' half of the gene was amplified as described above using the following two primers; 5'AATCGAATTCACCCCACTTTTTGACCTG-GAGG (SEQ ID NO:46) and 5'-CCGGGAGAG CGGC-CGCTCCAC (SEQ ID NO:47). The resulting 1300 base pair fragment was cut with restriction enzymes Eco RI and Not I and ligated into pTrc99a-Tfi3' cut with NotI and EcoRI to produce pTrc99a-TfiPol, SEQ ID NO:48 (the corresponding amino acid sequence is listed in SEQ ID NO:155).

The DNA polymerase I gene from *Thermus scotoductus* was amplified using the Advantage cDNA PCR kit (Clonetech) using the following two primers; 5'-ACTGGAATTCCTGCCCCTCTTTGAGCCCAAG (SEQ ID NO:49) and 5'-AACAGTCGAC CTAGGCCTTG-GCGGAAAGCC (SEQ ID NO:50). The PCR product was cut with restriction enzymes Eco RI and Sal I and ligated into Eco RI, Sal I cut pTrc99a to create pTrc99a-TscPol SEQ ID NO:51 (the corresponding amino acid sequence is listed in SEQ ID NO:268).

2. Expression and Purification of *Thermus filiformis* and *Thermus scotoductus*

Plasmids were transformed into protease deficient *E. coli* strain BL21 (Novagen) or strain JM109 (Promega Corp., Madison, Wis.) for protein expression. Flasks containing 200 ml of LB containing 100 µg/ml ampicillin were inoculated with either a single colony from an LB plate or from a frozen stock of the appropriate strain. After several hours of growth at 37° C. with vigorous shaking, cultures was induced by the addition of 200 µl of 1 M isothiopropyl-galatoside (IPTG). Growth at 37° C. was continued for 16 hours prior to harvest. Cells were pelleted by centrifugation at 8000×g for 15 minutes followed by suspension of the cell pellet in 5 ml of TEN (10 mM TrisHCl, pH 8.0, 1 mM EDTA, 100 mM NaCl). 100 µl of 50 mg/ml lysozyme were added and the cells incubated at room temperature for 15 minutes. Deoxycholic acid (10%) was added to a final concentration of 0.2%. After thorough mixing, the cell lysates were sonicated for 2 minutes on ice to reduce the viscosity of the mixture. Cellular debris was pelleted by centrifugation at 4° C. for 15 minutes at 20,000×g. The supernatant was removed and incubated at 70° C. for 30 min after which 10% polyethylimine (PEI) was added to 0.25%. After incubation on ice for 30 minutes, the mixture was centrifuged at 20,000×g for 20 min at 4° C. At this point, the supernatant containing the enzyme was removed, and the protein was precipitated by the addition of 1.2 g of ammonium sulfate and incubation at 4° C. for 1 hour. The protein was pelleted by centrifugation at 4° C. for 10 minutes at 20,000×g. The pellet was resuspended in 4 ml of HPLC Buffer A (50 mM TrisHCl, pH 8.0, 1 mM EDTA). The protein was further purified by affinity chromatography using an Econo-Pac heparin cartridge (Bio-Rad) and a Dionex DX 500 HPLC instrument. Briefly, the cartridge was equilibrated with HPLC Buffer A, and the enzyme extract was loaded on the column and eluted with a linear gradient of NaCl (0–2 M) in the same buffer. Pure protein elutes between 0.5 and 1 M NaCl. The enzyme peak was collected and dialyzed in 50% glycerol, 20 mM Tris HCl, pH 8, 50 mM KCl, 0.5% Tween 20, 0.5% Nonidet P40, 100 mg/ml BSA.

C. Generation of Polymerase Mutants with Reduced Polymerase Activity but Unaltered 5' Nuclease Activity All mutants generated in section C were expressed and purified as described in Example 2A1C.

1. Modified TaqPol Genes: TaqDN

A polymerization deficient mutant of Taq DNA polymerase called TaqDN was constructed. TaqDN nuclease contains an asparagine residue in place of the wild-type aspartic acid residue at position 785 (D785N).

DNA encoding the TaqDN nuclease was constructed from the gene encoding the Taq A/G in two rounds of site-directed mutagenesis. First, the G at position 1397 and the G at position 2264 of the Taq A/G gene (SEQ ID NO:39) were changed to A at each position to recreate a wild-type TaqPol gene. In a second round of mutagenesis, the wild type TaqPol gene was converted to the Taq DN gene by changing the G at position 2356 to A. These manipulations were performed as follows.

DNA encoding the Taq A/G nuclease was recloned from pTTQ18 plasmid into the pTrc99A plasmid (Pharmacia) in a two step procedure. First, the pTrc99A vector was modified by removing the G at position 270 of the pTrc99A map, creating the pTrc99G cloning vector. To this end, pTrc99A plasmid DNA was cut with NcoI and the recessive 3' ends were filled-in using the Klenow fragment of E.coli polymerase I in the presence of all four dNTPs at 37° C. for 15 min. After inactivation of the Klenow fragment by incubation at 65° C. for 10 min, the plasmid DNA was cut with EcoRI and the ends were again filled-in using the Klenow fragment in the presence of all four dNTPs at 37° C. for 15 min. The Klenow fragment was then inactivated by incubation at 65° C. for 10 min. The plasmid DNA was ethanol precipitated, recircularized by ligation, and used to transform E.coli JM109 cells (Promega). Plasmid DNA was isolated from single colonies, and deletion of the G at position 270 of the pTrc99A map was confirmed by DNA sequencing.

In a second step, DNA encoding the Taq A/G nuclease was removed from the pTTQ18 plasmid using EcoRI and SalI and the DNA fragment carrying the Taq A/G nuclease gene was separated on a 1% agarose gel and isolated with Geneclean II Kit (Bio 101, Vista, Calif.). The purified fragment was ligated into the pTrc99G vector which had been cut with EcoRI and SalI. The ligation mixture was used to transform competent E.coli JM109 cells (Promega). Plasmid DNA was isolated from single colonies and insertion of the Taq A/G nuclease gene was confirmed by restriction analysis using EcoRI and SalI.

Plasmid DNA pTrcAG carrying the Taq A/G nuclease gene cloned into the pTrc99A vector was purified from 200 ml of JM109 overnight culture using QIAGEN Plasmid Maxi kit (QIAGEN, Chatsworth, Calif.) according to manufacturer's protocol. pTrcAG plasmid DNA was mutagenized using two mutageniic primers, E465 (SEQ ID NO:52) (Integrated DNA Technologies, Iowa) and R754Q (SEQ ID NO:53) (Integrated DNA Technologies), and the selection primer Trans Oligonucleotide AlwNI/SpeI (Clontech, Palo Alto, Calif., catalog #6488-1) according to TRANSFORMER Site-Directed Mutagenesis Kit protocol (Clontech, Palo Alto, Calif.) to produce a restored wild-type TaqPol gene (pTrcWT).

pTrcWT plasmid DNA carrying the wild-type TaqPol gene cloned into the pTrc99A vector was purified from 200 ml of JM109 overnight culture using QIAGEN Plasmid Maxi kit (QIAGEN, Chatsworth, Calif.) according to manufacturer's protocol. pTrcWT was then mutagenized using the mutagenic primer D785N (SEQ ID NO:54) (Integrated DNA Technologies) and the selection primer Switch Oligonucleotide SpeI/AlwNI (Clontech, Palo Alto, Calif., catalog #6373-1) according to TRANSFORMER Site-Directed Mutagenesis Kit protocol (Clontech, Palo Alto, Calif.) to create a plasmid containing DNA encoding the Taq DN nuclease. The DNA sequence encoding the Taq DN nuclease is provided in SEQ ID NO:55; the amino acid sequence of Taq DN nuclease is provided in SEQ ID NO:56.

2. Modified TthPol Gene: Tth DN

The Tth DN construct was created by mutating the TthPol described above. The sequence encoding an aspartic acid at position 787 was changed by site-specific mutagenesis as described above to a sequence encoding asparagine. Mutagenesis of pTrcTth-2 with the following oligonucleotide: 5'-CAGGAGGAGCTCGTTGTGGACCTGGA-3' (SEQ ID NO:57) was performed to create the plasmid pTrcTthDN. The mutant protein and protein coding nucleic acid sequence is termed TthDN SEQ ID NOS:58 and 59 respectively.

3. Taq DN HT and Tth DN HT

Six amino acid histidine tags (his-tags) were added onto the carboxy termini of Taq DN and Tth DN. The site directed mutagenesis was performed using the TRANSFORMER Site Directed Mutagenesis Kit (Clontech) according to the manufacturer's instructions. The mutagenic oligonucleotides used on the plasmids pTaq DN and pTth DN were sequence 117-067-03, 5'-TCTAGAGGATCTATC AGTG-GTGGTGGTGGTGGTGCTCCTTGGCGGAGAGC3' (SEQ ID NO:60) and 5'-TGCCTGCAGGTCGAC GCTAGCTAGTGGTGGTGGTGGTGGTGACCCTTGG CGGAAAGCC-3' (SEQ ID NO:61), sequence 136-037-05. The selection primer Trans Oligo AlwNI/SpeI (Clontech, catalog #6488-1) was used for both mutagenesis reactions. The resulting mutant genes were termed Taq DN HT (SEQ ID NO:62, nucleic acid sequence; SEQ ID NO:63, amino acid sequence) and Tth DN HT (SEQ ID NO:64, nucleic acid sequence; SEQ ID NO:65, amino acid sequence).

4. Purification of Taq DN HT and Tth DN HT

Both Taq DN HT and Tth DN HT proteins were expressed in E. coli strain JM109 as described in Example 2B2. After ammonium sulfate precipitation and centrifugation, the protein pellet was suspended in 0.5 ml of Q buffer (50 mM Tris-HCl pH 8.0, 0.1 mM EDTAm 0.1% Tween 20). The protein was further purified by affinity chromatography using His-Bind Resin and Buffer Kit (Novagen) according to the manufacturer's instructions. 1 ml of His-Bind resin was transferred into a column, washed with 3 column volumes of sterile water, charged with 5 volumes of 1×Charge Buffer, and equilibrated with 3 volumes of 1X Binding Buffer. Four ml of 1×Binding Buffer was added to the protein sample and the sample solution was loaded onto the column. After washing with 3 ml of 1×Binding Buffer and 3 ml of 1×Wash Buffer, the bound His-Tag protein was eluted with 1 ml of 1×Elute Buffer. The pure enzyme was then dialyzed in 50% glycerol, 20 mM Tris-HCl, pH 8.0, 50 mM KCl, 0.5% Tween 20, 0.5% Nonidet P40, and 100 µg.ml BSA. Enzyme concentrations were determined by measuring absorption at 279 mn.

EXAMPLE 3

RNA-dependent 5' Nuclease Activity of TthPol can Be Conferred on TaqPol by Transfer of the N-terminal Portion of the DNA Polymerase Domain A. Preparation and Purification of Substrate Structures Having Either a DNA or an RNA Target Strand The downstream (SEQ ID NO:16) and upstream probes (SEQ ID NO:15) and the IL-6 DNA (SEQ ID NO:18) (FIG. 10) target stand were synthesized on a PerSeptive Biosystems instrument using standard phosphoramidite chemistry (Glen Research). The synthetic RNA-DNA chimeric IrT target labeled with biotin at the 5'-end (FIG. 20A) was synthesized utilizing 2'-ACE RNA chemistry (Pharmacon Research). The 2'-protecting groups were removed by acidatalyzed hydrolysis according to the manufacturer's instructions. The downstream probes labeled with 5'-fluorescein (Fl) or 5'-tetrachloro-fluorescein (TET) at their 5' ends were purified by reverse phase HPLC using a Resource Q column (Amersham-Pharmacia Biotech). The 648-nucleotide IL-6 RNA target (SEQ ID NO:17) (FIG. 10) was synthesized by T7 RNA polymerase runoff-transcription of the cloned fragment of human IL-6 cDNA (nucleotides 64–691 of the sequence published in May et al., Proc. Natl. Acad. Sci., 83:8957 [1986]) using a Megascript Kit (Ambion). All oligonucleotides were finally purified by separation on a 20% denaturing polyacrylamide gel followed by excision and elution of the major band. Oligonucleotide concentration was determined by measuring absorption at 260 nm. The biotin labeled IrT target was incubated with a 5-fold excess of streptavidin (Promega) in a buffer containing 10 mM MOPS, pH 7.5, 0.05% Tween 20, 0.05% NP-40 and 10 $\mu$g/ml tRNA at room temperature for 10 min.

B. Introduction of Restriction Sites to Make Chimeras

The restriction sites used for formation of chimerical proteins, described below, were chosen for convenience. The restriction sites in the following example have been strategically placed to surround regions shown by crystal structure and other analysis to be functional domains (See, FIGS. 6, 7, and 19). Different sites, either naturally occurring or created via directed mutagenesis can be used to make similar constructs with other Type A polymerase genes from related organisms. It is desirable that the mutations all be silent with respect to protein function. By studying the nucleic acid sequence and the amino acid sequence of the protein, one can introduce changes in the nucleic acid sequence that have no effect on the corresponding amino acid sequence. If the nucleic acid change required affects an amino acid, one can make the alteration such that the new amino acid has the same or similar characteristics of the one replaced. If neither of these options is possible, one can test the mutant enzyme for function to determine if the nucleic acid alteration caused a change in protein activity, specificity or function. It is not intended that the invention be limited by the particular restriction sites selected or introduced for the creation of the improved enzymes of the present invention.

C. Generation of Tth DN RX HT and Taq DN RX HT

Mutagenesis was performed to introduce 3 additional, unique restriction sites into the polymerase domain of both the Taq DN HT and Tth DN HT enzymes. Site specific mutagenesis was performed using the Transformer Site-Directed Mutagenesis Kit from (Clonetech) according to manufacturer's instructions. One of two different selection primers, Trans Oligo AlwNI/SpeI or Switch Oligo SpeI/AlwNI (Clontech, Palo Alto Calif. catalog #6488-1 or catalog #6373-1) was used for all mutagenesis reactions described. The selection oligo used in a given reaction is dependent on the selection restriction site present in the vector. All mutagenic primers were synthesized by standard synthetic chemistry. Resultant colonies were expressed in E.coli strain JM109.

The Not I sites (amino acid position 328) were created using the mutagenic primers 5'-gccgccaggggcggccgcgtccaccgggcc (SEQ ID NO:66) and 5'-gcctgcaggggcggccgcgtgcaccggggca (SEQ ID NO:67) corresponding to the sense strands of the Taq DN HT and the Tth DN HT genes, respectively. The BstI (amino acid position 382) and NdeI (amino acid position 443) sites were introduced into both genes using sense strand mutagenic primes 5'-ctcctggacccttcgaacaccacccc (SEQ ID NO:68) and 5'-gtcctggcccatatggaggccac (SEQ ID NO:69). The mutant plasmids were over-expressed and purified using Qiagen QiaPrep Spin Mini Prep Kit (cat. #27106). The vectors were tested for the presence of the restriction sites by DNA sequencing and restriction mapping. These constructs are termed Tth DN RX HT (DNA sequence SEQ ID NO:70; amino acid sequence SEQ ID NO:72) and Taq DN RX HT (DNA sequence SEQ ID NO:71; amino acid sequence SEQ ID NO:73).

D. Chimeras

The chimeric constructs shown in FIG. 19 were created by exchanging homologous DNA fragments defined by the restriction endonuclease sites EcoRI (E) and BamHI (B), common for both genes, the cloning vector site SalI (S) and the new sites, NotI (N), BstBI (Bs), NdeI (D) created at the homologous positions of both genes by site directed mutagenesis. In generating these chimeric enzymes, two different pieces of DNA are ligated together to yield the final construct. The larger piece of DNA that contains the plasmid vector as well as part of the Taq or Tth (or parts of both) sequence will be termed the "vector." The smaller piece of DNA that contains sequences of either the Taq or Tth (or parts of both) polymerase will be termed the "insert."

All restriction enzymes were from New England Biolabs or Promega and used in reactions with the accompanying buffer, according to the manufacturer's instructions. Reactions were done in 20 $\mu$l volume with about 500 ng of DNA per reaction, at the optimal temperature for the specified enzyme. More than one enzyme was used in a single reaction (double digest) if the enzymes were compatible with respect to reaction buffer conditions and reaction temperature. If the enzymes in question were not compatible with respect to buffer conditions, the enzyme requiring the lowest salt condition was used first. After the completion of that reaction, buffer conditions were changed to be optimal or better suited to the second enzyme, and the second reaction was performed. These are common restriction enzyme digest strategies, well known to those in the art of basic molecular biology (Maniatis, supra).

The digested restriction fragments were gel isolated for optimal ligation efficiency. Two $\mu$l of 10X loading dye (50% glycerol, 1xTAE, 0.5% bromophenol blue) were added to the 20 $\mu$l reaction. The entire volume was loaded and run on a 1%, 1xTAE agarose gel containing 1 $\mu$l of a 1% ethidium bromide solution per 100 ml of agarose gel solution. The digested fragments were visualized under UV light, and the appropriate fragments (as determined by size) were excised from the gel. These fragments were then purified using the Qiagen Gel Extractio Kit, (cat #28706) according to the manufacturer's instructions.

Ligations were performed in a 10 $\mu$l volume, using 400 units per reaction of T4 DNA Ligase enzyme from New England Biolabs (catalog #202L), with the accompanying reaction buffer. Ligation reactions were done at room temperature for 1 hour, with 1 µl of each of the Qiagen-purified fragments (approximately 20–50 ng of each DNA, depending on recovery from the gel isolation). Ligation products were then transformed into *E. coli* strain JM 109 and plated onto an appropriate growth and selection medium, such as LB with 100 µg/ml of ampicillin to select for transformants.

For each ligation reaction, six transformants were tested to determine if the desired construct was present. Plasmid DNA was purified and isolated using the QiaPrep Spin Mini Prep Kit, according to manufacturer's instructions. The constructs were verified by DNA sequencing and by restriction mapping.

Expression and purification of the chimeric enzymes was done as follows. Plasmids were transformed into *E. coli* strain JM109 (Promega). Log phase cultures (200 ml) of JM109 were induced with 0.5 mM IPTG (Promega) and grown for an additional 16 hours prior to harvest. Crude extracts containing soluble proteins were prepared by lysis of pelleted cells in 5 ml of 10 mM Tris-HCl pH 8.3, 1 mM EDTA, 0.5 mg/ml lysozyme during incubation at room temperature for 15 minutes. The lysate was mixed with 5 ml of 10 mM Tris-HCl pH 7.8, 50 mM KCl, 1 mM EDTA, 0.5% Tween 20, 0.5% Nonidet P-40, heated at 72° C. for 30 minutes, and cell debris was removed by centrifugation at 12,000×g for 5 minutes. Final purification of the protein was done by affinity chromatograpy using an Econo-Pac heparin cartridge (Bio-Rad) and Dionex DX 500 HPLC instrument. Briefly, the cartridge was equilibrated with 50 mM Tris-HCl pH 8, 1 mM EDTA, and an enzyme extract dialyzed against the same buffer was loaded on the column and eluted with a linear gradient of NaCl (0–2 M) in the same buffer. The HPLC-purified protein was dialyzed and stored in 50% (vol/vol) glycerol, 20 mM Tris-HCl pH 8.0, 50 mM KCl, 0.5% Tween 20, 0.5% Nonidet P-40, and 100 µg/m BSA. The enzymes were purified to homogeneity according to SDS-PAGE, and the enzyme concentrations were determined by measuring absorption at 279 nm.

1. Construction of TaqTth(N) and TthTaq(N)

The first exchange that was performed involved the polymerase domains of the two enzymes. Separation of the nuclease domain (the N-terminal end of the protein) from the polymerase domain (the C-terminal portion of the protein) was accomplished by cutting both genes with the restriction endonucleases EcoRI and NotI. The approximately 900 base pair fragment from the Tth DN RX HT gene was cloned into the homologous sites of the Taq DN RX HT gene, and the approximately 900 base pair fragment from the Taq DN RX HT gene was cloned into the homologous sites of the Tth DN RX HT gene, yielding two chimeras, TaqTth (N) (DNA sequence SEQ ID NO:74; amino acid sequence SEQ ID NO:75) which has the Taq DN RX HT 5' nuclease domain and the Tth DN RX HT polymerase domain, and TthTaq(N) (DNA sequence SEQ ID NO:76; amino acid sequence SEQ ID NO:77) which is made up of the Tth DN RX HT 5' nuclease domain and the Taq DN RX HT polymerase domain.

2. Construction of TaqTth(N-B)

The Taq DN RX HT construct was cut with the enzymes NdeI and BamHI and the larger, vector fragment was gel isolated as detailed above. The Tth DN RX HT construct was also cut with NdeI and BamHI and the smaller (approximately 795 base pairs) Tth fragment was gel isolated and purified. The Tth NdeI-BamHI insert was ligated into the Taq NdeI-BamHI vector as detailed above to generate the TaqTth(N-B) (DNA sequence SEQ ID NO:78; amino acid sequence SEQ ID NO:79).

3. Construction of TaqTth(B-S)

The Taq DN RX HT construct was cut with the enzymes BamHI and SalI and the larger vector fragment was gel isolated as detailed above. The Tth DN RX HT construct was also cut with BamHI and SalI and the smaller (approximately 741 base pairs) Tth fragment was gel isolated and purified. The Tth BamHI-SalI insert was ligated into the Taq BamHI-SalI vector as detailed above to generate the TaqTth(B-S) (DNA sequence SEQ ID NO:80; amino acid sequence SEQ ID NO:81).

4. Construction of TaqTth(N-D)

The Taq DN RX HT construct was cut with the enzymes NotI and NdeI and the larger vector fragment was isolated as detailed above. The Tth DN RX HT construct was also cut with NotI and NdeI and the smaller (approximately 345 base pairs) Tth fragment was gel isolated and purified. The Tth NotI-NdeI insert was ligated into the Taq NotI-NdeI vector as detailed above to generate the TaqTth(N-D) (DNA sequence SEQ ID NO:82; amino acid sequence SEQ ID NO:83).

5. Construction of TaqTth(D-B)

The Taq DN RX HT construct was cut with the enzymes NdeI and BamHI and the larger vector fragment was isolated as detailed above. The Tth DN RX HT construct was also cut with NdeI and BamHI and the smaller (approximately 450 base pairs) Tth fragment was gel isolated and purified. The Tth NdeI-BamHI insert was ligated into the Taq NdeI-BamHI vector as detailed above to generate the TaqTth(D-B) (DNA sequence SEQ ID NO:84; amino acid sequence SEQ ID NO:85).

6. Construction of TaqTth(Bs-B)

The Taq DN RX HT construct was cut with the enzymes BstBI and BamHI and the larger vector fragment was isolated as detailed above. The Tth DN RX HT construct was also cut with BstBI and BamHI and the smaller (approximately 633 base pairs) Tth fragment was gel isolated and purified. The Tth NdeI-BamHI insert was ligated into the Taq NdeI-BamHI vector as detailed above to generate TaqTth(Bs-B) (DNA sequence SEQ ID NO:86; amino acid sequence SEQ ID NO:87).

7. Construction of TaqTth(N-Bs)

The Taq DN RX HT construct was cut with the enzymes NotI and BstBI and the larger vector fragment was isolated as detailed above. The Tth DN RX HT construct was also cut with NotI and BstBI and the smaller (approximately 162 base pairs) Tth fragment was gel isolated and purified. The Tth NotI-BstBI insert was ligated into the Taq NotI-BstBI vector as detailed above to generate TaqTth(N-Bs) (DNA sequence SEQ ID NO:88; amino acid sequence SEQ ID NO:89).

8. Construction of TthTaq(BS)

The Tth DN RX HT construct was cut with the enzymes BamHI and SalI and the larger vector fragment was isolated as detailed above. The Taq DN RX HT construct was also cut with BamHI and SalI and the smaller (approximately 741 base pairs) Tth fragment was gel isolated and purified. The Taq BamHI-SalI insert was ligated into the Tth BamHI-SalI vector as detailed above to generate the TthTaq(B-S) (DNA sequence SEQ ID NO:90; amino acid sequence SEQ ID NO:91).

9. Construction of Tth Taq(N-B)

The Tth DN RX HT construct was cut with the enzymes NotI and BamHI and the larger vector fragment was isolated as detailed above. The Taq DN RX HT construct was also cut with NotI and BamHI and the smaller (approximately 795 base pairs) Tth fragment was gel isolated and purified. The Taq NotI-BamHI insert was ligated into the Tth NotI-BamHI vector as detailed above to generate the TthTaq(N-

B) (DNA sequence SEQ ID NO:92; amino acid sequence SEQ ID NO:93).

The cleavage activities of these chimerical proteins were characterized as describe in Example 1, part A, and a comparison of the cleavage cycling rates on an RNA target is shown in FIG. 12. As further discussed in the Description of the Invention, these data show that elements found in the central third of the TthPol protein are important in conferring the TthPol-like RNA-dependent cleavage activity on the chimerical proteins comprising portions of TaqPol.

EXAMPLE 4
Alterations Influencing RNA-dependent 5' Nuclease Activity do not Necessarily Influence RNA-dependent DNA Polymerase Activity TthPol is known to have a more active RNA template dependent DNA polymerase than does the TaqPol (Myers and Gelfand, Biochemistry 30:7661 [1991]). To determine whether the RNA template dependent 5' nuclease activity of the Thermus DNA Pol I enzymes is related to their RNA-dependent polymerase activity, the D785N and D787N mutations used to create the polymerase deficient versions of TaqPol and TthPol, respectively were reversed. Polymerase activity was similarly restored to the TaqTth (N) (DNA sequence SEQ ID NO:94; amino acid sequence SEQ ID NO:95), TaqTth(N-B) (DNA sequence SEQ ID NO:96; amino acid sequence SEQ ID NO:97), TaqTth(B-S) (DNA sequence SEQ ID NO:98; amino acid sequence SEQ ID NO:99) chimeras, and the TaqPol(W417L/G418K/E507Q) (DNA sequence SEQ ID NO:100; amino acid sequence SEQ ID NO:101) mutant proteins.

Polymerase function was restored in all the above mentioned enzyme mutants by inserting the BamHI to SalI fragment of the native, non-DN sequence into the selected chimera or mutant enzyme. For example, the mutant construct TaqTth(N-B) was cut with the restriction enzyme BamHI (approximate amino acid position 593) and the restriction enzyme SalI (approximate amino acid position 840). The larger vector fragment was gel purified as described in Example 3D. The native TaqPol construct was also cut with the restriction endonucleases BamHI and SalI, and the smaller insert fragment containing the native amino acid sequence was also gel purified. The insert fragment was then ligated into the vector as detailed in Experimental Example 3D.

The polymerase activities of these proteins were evaluated by extension of the $dT_{25-35}$-oligonucleotide primer with fluorescein-labeled dUTP in the presence of either poly(dA) or poly(A) template. Primer extension reactions were carried out in 10 μl buffer containing 10 mM MOPS, pH7.5, 5 mM $MgSO_4$, 100 mM KCl. Forty ng of enzyme were used to extend 10 μM $(dT)_{25-30}$ primer in the presence of either 10 μM poly(A)$_{286}$ or 1 μM poly(dA)$_{273}$ template, 45 μM dTTP and 5 μM Fl-dUTP at 60° C. for 30 min. Reactions were stopped with 10 μl of stop solution (95% formamide, 10 mM EDTA, 0.02% methyl violet dye). Samples (3 μl) were fractionated on a 15% denaturing acrylamide gel and the fraction of incorporated Fl-dUTP was quantitated using an FMBIO-100 fluorescent gel scanner (Hitachi) equipped with a 505 nm filter as described above.

As shown in FIG. 16, the DNA-dependent polymerase activities are very similar for all constructs used in this experiment, whereas the RNA-dependent polymerase activities of TthPol, TaqTth(N) and TaqTth(B-S) are at least 6-fold higher than the activities of TaqPol, TaqTth(N-B) and the TaqPol W417L/G418K/E507Q mutant. From the analysis of these results, it can be concluded that the high RNA-dependent DNA polymerase activity of TthPol is determined by the C-terminal half of the polymerase domain (roughly, amino acids 593–830) and that the RNA-dependent 5' nuclease and polymerase activities are not related to each other, and are controlled by different regions.

EXAMPLE 5
Specific Point Mutants in Taq DN RX HT Developed from Information from the Chimeric Studies The chimeric studies (Example 3, above) suggest that the part of the TthPol sequence determining its high RNA-dependent 5' nuclease activity comprises the BstBI-BamHI region located approximately between amino acid 382 and 593. Comparison of the amino acid sequences between the BstBI and BamHI regions of Tth DN RX HT and Taq DN RX HT (SEQ ID NOS:20 and 19, respectively) revealed only 25 differences (FIG. 13). Among these, 12 amino acid changes were conservative while 13 of the differences resulted in a changes in charge. Since the analysis of the chimeric enzymes suggested that the critical mutations are located in both the BstBI-NdeI and the NdeI-BamHI regions of Tth DN RX HT, site specific mutagenesis was used to introduce the Tth DN RX HT specific amino acids into the BstBI-NdeI and NdeI-BamHI regions of the TaqTth(D-B) and the TaqTth(N-D) respectively.

Six Tth DN RX HT specific substitutions were generated in the BstBI-NdeI region of the TaqTth(D-B) by single or double amino acid mutagenesis. Similarly, 12 Tth DN RX HT specific amino acid changes were introduced at the homologous position of the NdeI-BamHI region of the TaqTth(N-D).

Plasmid DNA was purified from 200 ml of JM109 overnight culture using QIAGEN Plasmid Maxi Kit (QIAGEN, Chatsworth, Calif.) according to the manufacturer's protocol to obtain enough starting material for all mutagenesis reactions. All site specific mutations were introduced using the Transformer Site Directed mutagenesis Kit (Clontech) according to the manufacturer's protocol; specific sequence information for the mutagenic primers used for each site is provided below. One of two different selection primers, Trans Oligo AlwNI/SpeI or Switch Oligo SpeI/AlwNI (Clontech, Palo Alto, Calif. catalog #6488-1 or catalog #6373-1) was used for all mutagenesis reactions described. The selection oligo used in a given reaction is dependent on the restriction site present in the vector. All mutagenic primers were synthesized by standard synthetic chemistry. Resultant colonies were E.coli strain JM109.

1. Construction of TaqTth(D-B) E404H (DNA sequence SEQ ID NO:102; Amino Acid Sequence SEQ ID NO:103)

Site specific mutagenesis was performed on pTrc99A TaqTth(D-B) DNA using the mutagenic primer 240-60-01 5'-gag gag gcg ggg cac cgg gcc gcc ctt-3' (SEQ ID NO:104) to introduce the E404H mutation.

2. Construction of TaqTth(D-B) F413H/A414R (DNA sequence SEQ ID NO:105; Amino Acid Sequence SEQ ID NO:106)

Site specific mutagenesis was performed on pTrc99A TaqTth(D-B) DNA using the mutagenic primer 240-60-02 5'-ctt tcc gag agg ctc cat cgg aac ctg tgg ggg agg-3' (SEQ ID NO:107) to introduce the F413H and the A414R mutations.

3. Construction of TaqTth(DB) W417L/G418K (DNA sequence SEQ ID NO:108; amino acid sequence SEQ ID NO:109)

Site specific mutagenesis was performed on pTrc99A TaqTth(D-B) DNA using the mutagenic primer 240-60-03 5'-ctc ttc gcc aac ctg ctt aag agg ctt gag ggg gag-3' (SEQ ID NO:110) to introduce the W417L and the G418K mutations.

4. Construction of TaqTth(D-B) A439R (DNA sequence SEQ ID NO:111; amino acid sequence SEQ ID NO:112)

Site specific mutagenesis was performed on pTrc99A TaqTth(ND-B) DNA using the mutagenic primer 240-60-04 5'-agg ccc ctt tcc cgg gtc ctg gcc cat-3' (SEQ ID NO.113) to introduce the A439R mutation.

5. Construction of TaqTth(N-D) L451R (DNA sequence SEQ ID NO:114; amino acid sequence SEQ ID NO:115)

Site specific mutagenesis was performed on pTrc99AtaqTth(N-D) DNA using the mutagenic primer 240-60-05 5'-acg ggg gtg cgc cgg gac gtg gcc tat-3' (SEQ ID NO:116) to introduce the L415 mutation.

6. Construction of TaqTth(N-D) R457Q (DNA sequence SEQ ID NO:117; amino acid sequence SEQ ID NO:118)

Site specific mutagenesis was performed on pTrc99AtaqTth(N-D) DNA using the mutagenic primer 240-60-06 5'-gtg gcc tat ctc cag gcc ttg tcc ctg-3' (SEQ ID NO:119) to introduce the L415Q mutation.

7. Construction of TaqTth(N-D) V463L (DNA sequence SEQ ID NO:120; amino acid sequence SEQ ID NO:121)

Site specific mutagenesis was performed on pTrc99AtaqTth(N-D) DNA using the mutagenic primer 240-60-07 5'-ttg tcc ctg gag ctt gcc gag gag atc-3' (SEQ ID NO:122) to introduce the V463L mutation.

8. Construction of TaqTth(N-D) A468R (DNA sequence SEQ ID NO:123; amino acid sequence SEQ ID NO:124)

Site specific mutagenesis was performed on pTrc99AtaqTth(N-D) DNA using the mutagenic primer 240-60-08 5'-gcc gag gag atc cgc cgc ctc gag gcc-3' (SEQ ID NO:125) to introduce the A468R mutation.

9. Construction of TaqTth(N-D) A472E (DNA sequence SEQ ID NO:126; amino acid sequence SEQ ID NO:127)

Site specific mutagenesis was performed on pTrc99AtaqTth(N-D) DNA using the mutagenic primer 240-60-09 5'-gcc cgc ctc gag gag gag gtc ttc cgc-3' (SEQ ID NO:128) to introduce the A472E mutation.

10. Construction of TaqTth(N-D) G499R (DNA sequence SEQ ID NO:129; amino acid sequence SEQ ID NO:130)

Site specific mutagenesis was performed on pTrc99AtaqTth(N-D) DNA using the mutagenic primer 240-60-10 5'-ttt gac gag cta agg ctt ccc gcc atc-3' (SEQ ID NO:131) to introduce the G499R mutation.

11. Construction of TaqTth(N-D) E507Q (DNA sequence SEQ ID NO:132; amino acid sequence SEQ ID NO:133)

Site specific mutagenesis was performed on pTrc99AtaqTth(N-D) DNA using the mutagenic primer 276-046-04 5'-atc gcc aag acg caa aag acc ggc aag-3' (SEQ ID NO:134) to introduce the E507Q mutation.

12. Construction of TaqTth(N-D) Y535H (DNA sequence SEQ ID NO:135; amino acid sequence SEQ ID NO:136)

Site specific mutagenesis was performed on pTrc99AtaqTth(N-D) DNA using the mutagenic primer 240-60-11 5'-aag atc ctg cag cac cgg gag ctc acc-3' (SEQ ID NO:137) to introduce the Y535H mutation.

13. Construction of TaqTth(N-D) S543N (DNA sequence SEQ ID NO:138; amino acid sequence SEQ ID NO:139)

Site specific mutagenesis was performed on pTrc99AtaqTth(N-D) DNA using the mutagenic primer 240-60-12 5'-acc aag ctg aag aac acc tac att gac-3' (SEQ ID NO:140) to introduce the S543N mutation.

14. Construction of TaqTth(N-D) I546V (DNA sequence SEQ ID NO:141; amino acid sequence SEQ ID NO:142)

Site specific mutagenesis was performed on pTrc99AtaqTth(N-D) DNA using the mutagenic primer 240-60-13 5'-aag agc acc tac gtg gac ccc ttg ccg-3' (SEQ ID NO:143) to introduce the I546V mutation.

15. Construction of TaqTth(N-D) D551S/I553V (DNA sequence SEQ ID NO:144; amino acid sequence SEQ ID NO:145)

Site specific mutagenesis was performed on pTrc99AtaqTth(N-D) DNA using the mutagenic primer 240-60-14 5'-att gac ccc ttg ccg agc ctc gtc cac ccc agg acg ggc-3' (SEQ ID NO:146) to introduce the D551S and the I553V mutations.

16. Construction of TaqDN RX HT W417L/G418K/E507Q (DNA sequence SEQ ID NO:147; amino acid sequence SEQ ID NO:148)

The TaqDN RX HT W417L/G418K/E507Q triple mutant was made by combining the TaqTth(D-B)W417L/G418K with the TaqTth(N-D) E507Q. TaqTth(D-B)W417L/G418K was cut with the restriction enzymes NdeI and BamHI, and the larger, vector fragment was isolated as detailed in Example 3. The TaqTth(N-D) E507Q construct was also cut with NdeI and BamHI and the smaller (approximately 795 base pairs) fragment was gel isolated and purified as detailed in Example 3. The NdeI-BamhI insert was ligated into the gel purified vector, as detailed in Example 3.

17. Construction of TaqDN RX HT W417L/E507Q (DNA sequence SEQ ID NO:149; amino acid sequence SEQ ID NO:150)

Starting with TaqDN RX HT W417L/G418K/E507Q described above, mutagenic primer 337-01-02: 5'-TTC QCC AAC CTG CTT GGG AGG CTT GAG GGG GAG -3' (SEQ ID NO:151) was used in a site specific mutagenesis reaction to change the K at amino acid position 418 back to the wild-type amino acid, G. Site specific mutagenesis was done using the Transformer Site Directed Mutagenesis Kit (Clonetech) according to the manufacturer's instructions, and as described in Experimental Example 4.

18. Construction of TaqDN RX HT G418K/E507Q (DNA sequence SEQ ID NO:152; amino acid sequence SEQ ID NO:153)

Starting with TaqDN RX HT W417L/G418K/E507Q described above, mutagenic primer 337-01-01: 5° CTC TTC GCC AAC CTG TOG AAG AGG CIT GAG GGG -3' was used in a site specific mutagenesis reaction to change the L at amino acid position 417 back to the wild-type amino acid, W. Site specific mutagenesis was done using the Transformer Site Directed Mutagenesis Kit (Clonetech) according to the manufacturer's instructions, and as described in Experimental Example 4.

Figure 14:
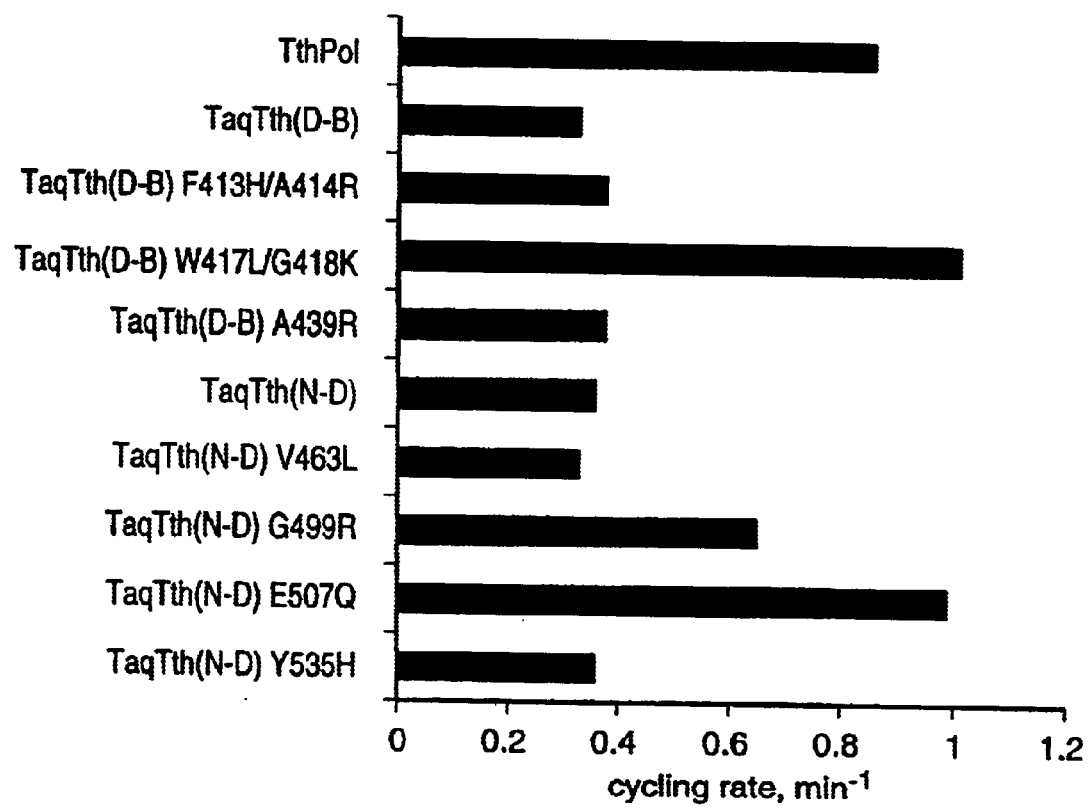
FIG. 14 compares the cycling cleavage activities of Taq DN RX HT, Taq-Tth chimerical enzymes, and chimerical enzymes having the indicated additional amino acid modifications, with IL-6 substrate having an RNA target strand.

Expression and purification of mutant proteins was done as detailed in Example 3, and the cleavage activities of these proteins were characterized as describe in Example 1, part A. A comparison of the cleavage cycling rates of a selection of these mutant proteins on an RNA target is shown in FIG. 14. As further discussed in the Description of the Invention, these data show that amino acids in the regions 417/418 and amino acid 507 are important in the conferring the TthPol-like RNA-dependent cleavage activity on the chimerical proteins comprising portions of TaqPol in combination with portions of TthPol that are not independently capable of providing enhanced RNA dependent activity (i.e., the D-B and N-D portions of Tth). As described in the Description of the Invention, Taq DN RX HT variant carrying only the W417L, G418K and E507Q substitutions were created. By comparing their cleavage rates to that of Tth DN RX HT on the IL-6 RNA substrate as described in Example 1, these mutations were determined to be sufficient to increase the Taq DN RX HT activity to the Tth DN RX HT level. FIG. 15 shows that the Taq DN RX HT W417L/G418K/E507Q and Taq DN RX HT G418K/E507Q mutants have 1.4 times higher activity than Tth DN RX HT and more than 4 fold higher activity than Taq DN RX HT, whereas the Taq DN RX HT W417L/E507Q mutant has the same activity as the enzyme, which is about 3 fold higher than Taq DN RX HT.

These results demonstrate that K418 and Q507 of TthPol are particularly important amino acids in providing RNA dependent 5' nuclease activity that is enhanced compared to TaqPol.

EXAMPLE 6
RNA-dependent 5' nuclease Properties of the Taq DN RX HT G418K/E507Q 5' nuclease are Similar to Tth DN RX HT with Respect to Salt and Temperature Optima To determine if the G418K/E507Q mutations caused any significant changes in the properties of the Taq DN RX HT mutant in addition to the increased cleavage rate with the RNA target, the Taq DN RX HT G418K/E507Q (SEQ ID NO:153), Taq DN RX HT (SEQ ID NO:73), and Tth DN RX HT (SEQ ID NO:72) enzymes were compared in the RNA template dependent 5' nuclease assay under conditions where temperature and the concentrations of salt and divalent ions were varied. The upstream DNA and the template RNA strands of the substrate used in this study were linked into a single IrT molecule (SEQ ID NO:27) as shown in FIG. 20A, and the labeled downstream probe (SEQ ID NO:26) was present in large excess. The 5' end of the target RNA strand was blocked with a biotin-streptavidin complex to prevent any non-specific degradation by the enzyme during the reaction (Lyamichev et al., Science 260:778 [1993], Johnson et al., Science 269:238 [1995]). The cleavage rates for Taq DN RX HT G418K/E507Q, Taq DN RX HT, and Tth DN RX HT are plotted as functions of temperature in FIG. 20B. The closed circles represent enzyme Taq DN RX HT, the open circles represent enzyme Tth DN RX HT, and the Xs represent enzyme Taq DN RX HT G418K/E507Q. The difference in the activities of Tth and Taq DN RX HT enzymes with the IrT substrate is even greater than the difference found with the IL-6 RNA substrate when tested in a cleavage assay as described in Example 1. The G418K/E507Q mutations increase the activity of the Taq enzyme more than tenfold and by 25% compared with the Tth enzyme. All three enzymes show a typical temperature profile of the invasive signal amplification reaction and have the same optimal temperature. No significant effect of G418K/E507Q mutations on DNA dependent 5' nuclease activity of Taq DN RX HT with the all-DNA substrate analogous to IrT (SEQ ID NO:28) under the same conditions was found.

Figure 20:
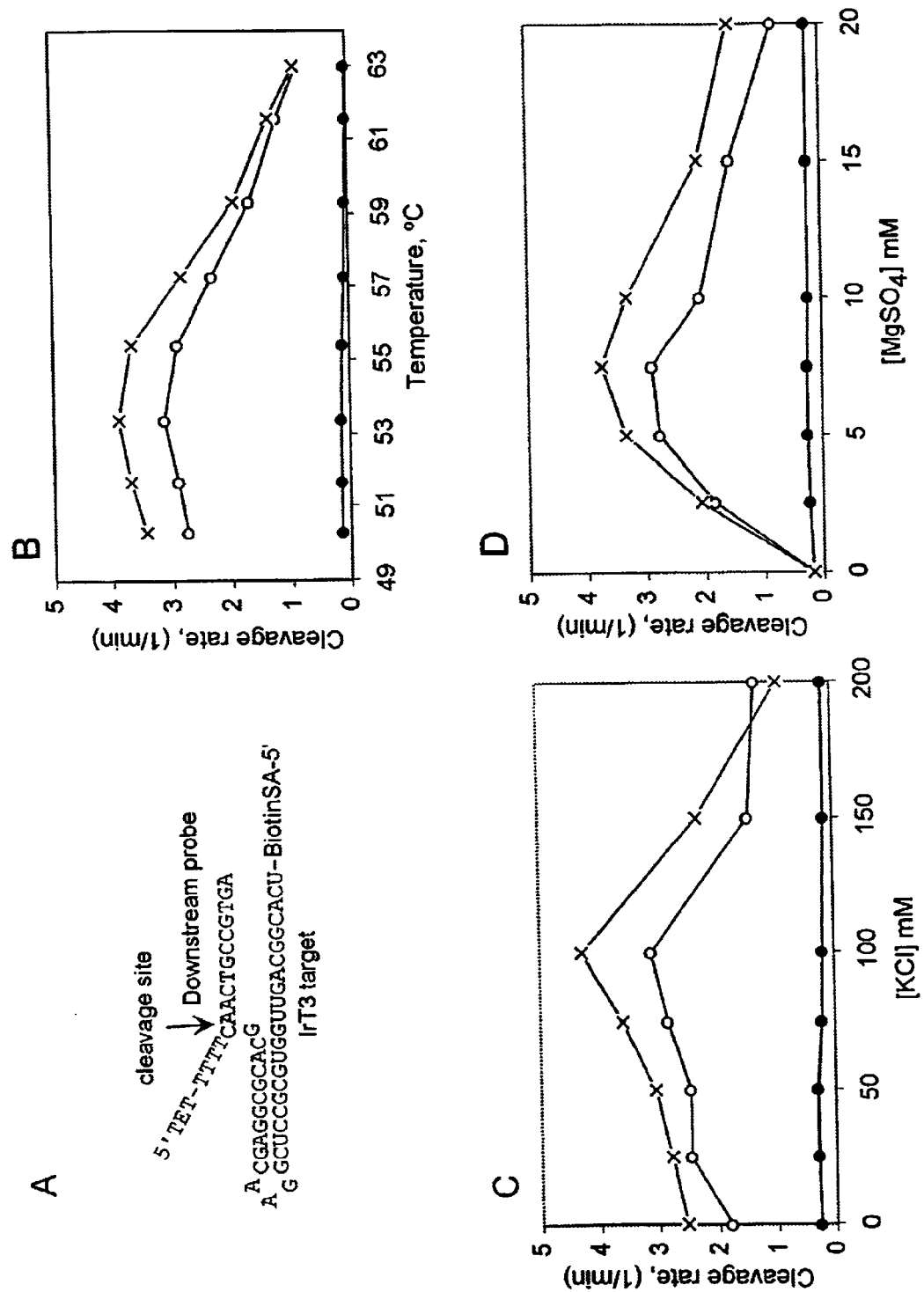
FIG. 20A shows a schematic diagram for an RNA containing invasive cleavage substrate. The 5' end of the target molecule (SEQ ID NO:27) is modified with biotin and blocked with streptavidin as described. The downstream probe (SEQ ID NO:26) with cleavage site is also shown. Panels B–D show analysis of the properties of the Taq DN RX HT G418K/E507Q mutant in cleavage of the shown substrate under conditions of varying reaction temperature, KCl concentration, and MgSO$_4$ concentration.

The effects of KCl and MgSO$_4$ concentrations on the 5' nuclease activity of Taq DN RX HT G418K/E507Q, Taq DN RX HT, and Tth DN RX HT with the IrT substrate are shown in FIGS. 20C and D. The activities of all enzymes have similar salt dependencies with an optimal KCl concentration of 100 mM for Taq DN RX HT G418K/E507Q and Tth DN RX HT and 50 mM for Taq DN RX HT. The optimal MgSO$_4$ concentration for all enzymes is approximately 8 mM. The analysis of the data presented in FIG. 20 suggests that the properties of Taq DN RX HT G418K/E507Q are much closer to those of Tth DN RX HT rather than Taq DN RX HT confirming the key role of the G418K/E507Q mutations in the recognition of the substrate with an RNA target.

To understand the mechanism of the reduction of the 5' nuclease activity in the presence of an RNA versus a DNA target, the Michaelis constant ($K_m$) and the maximal catalytic rate ($k_{cat}$) of all three enzymes were determined, using an excess of the IrT substrate (SEQ ID NO:27) and the downstream probe (SEQ ID NO:26) and a limiting enzyme concentration. For these measurements, ten-$\mu$l reactions were assembled containing 10 mM MOPS, pH 7.5, 0.05% Tween 20, 0.05% Nonidet P-40, 10 $\mu$g/ml tRNA, 4 mM MgCl$_2$, 1 nM of enzyme (Taq DN RX HT, Tth DN RX HT, or Taq DN RX HT G418K/E507Q) and different concentrations (0.125, 0.25, 0.5 or 1 $\mu$M) of an equimolar mixture of the IrT target and the downstream probe. The cleavage kinetics for each enzyme and each substrate concentration were measured at 46° C. Reactions were stopped by the addition of 10 $\mu$l of 95% formamide containing 10 mM EDTA and 0.02% methyl violet (Sigma). One $\mu$l of each stopped reaction digest was fractionated on a 20% denaturing acrylamide gel (19:1 cross-linked), with 7M urea, and in a buffer of 45 mM Tris-borate, pH 8.3, 1.4 mM EDTA. Gels were scanned on an FMBIO-100 fluorescent gel scanner (Hitachi) using a 585 run filter. The fraction of cleaved product (determined from intensities of bands corresponding to uncut and cut substrate with FMBIO Analysis software, version 6.0, Hitachi) was plotted as a function of reaction time. The initial cleavage rates were determined from the slopes of linear part of the cleavage linetics and were defined as the concentration of cut product divided by the enzyme concentration and the time of the reaction (in minutes). The Michaelis constant $K_m$ and the maximal catalytic rate $k_{cat}$ of each enzyme with IrT substrate were determined from the plots of the initial cleavage rate as functions of the substrate concentration.

It was found that all three enzymes have similar $K_m$ values (in the range of 200–300 nM) and $k_{cat}$ values of approximately 4 min$^{-1}$ for Taq DN RX HT and Tth DN RX HT and of 9 min$^{-1}$ for Taq DN RX HT G418K/E507Q. That the G418K/E507Q mutations increase the $k_{cat}$ of Taq DN RX HT more than two fold, but have little effect on $K_m$ suggest that the mutations position the substrate in an orientation more appropriate for cleavage, rather than simply increase the binding constant.

EXAMPLE 7
Use of Molecular Modeling to Further Improve RNA-dependent 5' nuclease Activity A. Point Mutants To develop enzymes with altered function, sequence changes were introduced by site specific mutagenesis in predetermined locations or by random mutagenesis. Locations for site specific mutagenesis were chosen based on evidence from chimeric studies, relevant published literature, and molecular modeling. Seven additional mutant enzymes were developed from the Tth DN RX HT enzyme, and twenty additional mutant enzymes were developed from the Taq DN RX HT enzyme, both discussed previously. Some of the mutant enzymes are the result of multiple mutagenesis reactions, that is, more than one change has been introduced to obtain the final product. Mutation reactions were done using the Tth DN RX HT construct (SEQ ID NO:70) described in Example 2C2, or the Taq DN RX HT construct (SEQ ID NO:71), described in Example 2C1 unless otherwise stated. Plasmid DNA was purified from 200 ml of JM109 overnight culture using QIAGEN Plasmid Maxi Kit (QIAGEN, Chatsworth, Calif.) according to the manufacturer's protocol to obtain enough starting material for all mutagenesis reactions. All site specific mutations were introduced using the Transformer Site Directed mutagenesis Kit (Clontech) according to the manufacturer's protocol. One of two different selection primers, Trans Oligo AlwNI/SpeI or Switch Oligo SpeI/AlwNI (Clontech, Palo Alto Calif. catalog #6488-1 or catalog #6373-1) was used for all mutagenesis reactions described. The selection oligo used in a given reaction is dependent on the restriction site present in the vector. All mutagenic primers for both the site specific mutagenesis and the random mutagenesis were synthesized by standard synthetic chemistry. Resultant colonies for both types of reactions were E.coli strain JM109. Random mutagenesis methods are described below.

Mutants were tested via the rapid screening protocol detailed in Example 1. Then, if more detailed analysis was desired, or if a larger protein preparation was required, expression and purification of mutant proteins was done as detailed in Example 3.

1. Construction of Tth DN RX HT H641A, Tth DN RX HT H748A, Tth DN RX HT H786A

Site specific mutagenesis was performed on pTrc99A Tth DN RX HT DNA using the mutagenic primer 583-001-02: 5'-gct tgc ggt ctg ggt ggc gat gtc ctt ccc ctc-3' (SEQ ID NO:158) to introduce the H641A mutation (DNA sequence SEQ ID NO:156; amino acid sequence SEQ ID NO:157), or the mutagenic primer 583-001-03: 5' cat gtt gaa ggc cat ggc ctc cgc ggc ctc cct-3' (SEQ ID NO:161) to generate the H748A mutant (DNA sequence SEQ ID NO:159; amino acid sequence SEQ ID NO:160), or the mutagenic primer 583-001-04: 5'-cag gag gag ctc gtt ggc gac ctg gag gag-3' (SEQ ID NO:164) to generate the H786A mutant enzyme (DNA sequence SEQ ID NO:162; amino acid sequence SEQ ID NO:163).

2. Construction of Tth DN RX HT (H786A/G506K/Q509K)

Starting with the mutant Tth DN RX HT H786A, generated above, site specific mutagenesis was done using the mutagenic primer 604-022-02: 5'-gga gcg ctt gcc tgt ctt ctt cgt ctt ctt caa ggc ggg agg cct-3' (SEQ ID NO:167) to generate this variant termed "TthAKK", (DNA sequence SEQ ID NO:165; amino acid sequence SEQ ID NO:166).

3. Construction of Taq DN RX HT (W417L/G418K/E507Q/H784A)

Mutagenic oligonucleotide 158-029-02: 5'-gag gac cag ctc gtt ggc gac ctg aag gag cat-3' (SEQ ID NO:170) was used in a site specific mutagenesis reaction to introduce the fill in H784A mutation and generate this construct termed "Taq4M" (DNA sequence SEQ ID NO:168; amino acid sequence SEQ ID NO:169).

4. Construction of Taq4M H639A, Taq4M R587A, Taq4M G504K and Taq4M G80E

Site specific mutagenesis was done on the Taq4M mutant, using primer 473-010-11: 5'-gaggggcgggacatcgccacggagaccgccagc-3' (SEQ ID NO:173) to generate the Taq 4M H639A mutant (DNA sequence SEQ ID NO:171; amino acid sequence SEQ ID NO:172), primer 473-010-10: 5'-cag aac atc ccc gtc gcc acc ccg ctt ggg cag-3' (SEQ ID NO:176) to generate Taq 4M R587A (DNA sequence SEQ ID NO:174; amino acid sequence SEQ ID NO: 175), primer 300-081-06: 5'-ggg ctt ccc gcc atc aag aag acg gag aag acc-3' (SEQ ID NO:179) to generate Taq 4M G504K (DNA sequence SEQ ID NO:177; amino acid sequence SEQ ID NO:178), and primer 330-088-04: 5'-cta ggg ctt ccc gcc atc aag aag acg caa aag acc ggc-3' (SEQ ID NO:182) to generate the Taq 4M G80E mutant (DNA sequence SEQ ID NO:180; amino acid sequence SEQ ID NO:181).

5. Construction of Taq 4M P88E/P90E and Taq 4M L109F/A110T

Starting with Taq 4M described above, site specific mutagenesis was done using primer 473-087-03: 5'-ccg ggg aaa gtc ctc ctc cgt ctc ggc ccg gcc cgc ctt-3' (SEQ ID NO:185) to generate the P88E/P90E mutations (DNA sequence SEQ ID NO:183; amino acid sequence SEQ ID NO:184), or primer 473-087-05: 5'-cgg gac ctc gag gcg cgt gaa ccc cag gag gtc cac-3' (SEQ ID NO:188) to generate the L109F/A110T mutations (DNA sequence SEQ ID NO:186; amino acid sequence SEQ ID NO:187).

6. Construction of Taq DN RX HT (W417L/G418K/G499R/A502K/I503L/G504K/E507K/H784A)

Two PCR reactions were performed, first using construct Taq4M (Taq W417L/G418K/G504K/E507Q/H784A) as a template. Using primers 158-84-01 5'-CTCCTCCACGAGTTCGGC-3' (SEQ ID NO:191) and 535-33-02 5'-ACC GGT CIT CTT CGT CICTT CAA CTT G AAG CCT GAG CTC GTC MA-3' (SEQ ID NO:192) a 620 base pair PCR fragment was generated. Another 510 base pair PCR product was generated using primer 535-33-01 5'-AAG ACG AAG AAG ACC GGT AAG CGC TCC ACC AGC-3' (SEQ ID NO:193) and 330-06-03 5'-GTC GAC TCT AGA TCA GTG GTG GTG GTG GTG GTG CIT GGC CGC CCG GCG CAT C-3' (SEQ ID NO:194). The two PCR products overlap such that a final recombinant PCR amplification was done using the too outside primers 158-84-01 and 330-06-03 to yield the 1182 base pair product. The recombinant PCR product was digested with the restriction enzymes NotI and BamHI according to the manufacturer's instructions to yield a 793 base pair fragment. The parent plasmid Taq4M was also digested with the same enzymes and used as the vector for ligation. All DNA fragments were TAE agarose gel purified prior to ligation. The fragment was ligated into the vector, and transformed into JM109 cells, thus incorporating the mutations G499R, A502K, I503L, and E507K as well as the restriction endonuclease site, AgeI. This construct is termed "Taq 8M" (DNA sequence SEQ ID NO:189; amino acid sequence SEQ ID NO:190).

B. Random Mutagenesis

Numerous enzymes with altered function were generated via random mutagenesis. The regions of the protein targeted for random mutagenesis were chosen based on molecular modeling data and from information in the literature. Different mutagenic primers were used to introduce mutations into different regions of the protein. Random mutagenesis was performed on the Taq variant Taq 4M G504K (Taq DN RX HT W417L/G418K/G504K/E507Q/H784A/) (SEQ ID NO:177) described above and mutant PCR fragments generated in the mutagenesis reaction were exchanged for homologous regions in Taq8M (SEQ ID NO:189) unless otherwise stated.

Random mutagenesis was also performed on the Tth DN RX HT H786A (SEQ ID NO:162) described above. Mutant PCR fragments generated with the Tth DN RX HT H786A template were exchanged for homologous regions in the unaltered Tth DN RX HT H786A.

1. Random mutants in amino acid residues 500–507 or 513–520

The first mutagenic oligonucleotide, 535-054-01: 5'-gga gcg ctt acc ggt cft (ttg cgt ctt ctt gat ctt ggg aag) cct tag ctc gtc aaa gag-3' (SEQ ID NO:195) was used in conjunction with 158-84-01: 5'-CTC CTC CAC GAG TTC GGC-3' (SEQ ID NO:196) to install random residues from amino acid position 500 to 507 of Taq polymerase variant Taq DN RX HT W417L/G418K/G504K/E507Q/H784A (SEQ ID NO:177). This was accomplished by synthesizing the primer 535-054-01 such that only 91% of the bases within the parenthesis are unaltered while the remaining 90% of the bases are an equal mixture of the other 3 nucleotides. The initial, unaltered sequence of this oligo includes the G499R, A502K and the Q507K changes.

To generate mutations in the region 500–507, primer 535-054-01 and primer 158-84-01 were used in a PCR reaction, using the Advantage CDNA PCR kdt (Clonetech) and Taq variant described above, as the target. This PCR fragments was then run on a 1% TAE agarose gel, excised and purified with QIAquick Gel Extraction Kit (Qiagen, Valencia Calif., catalog #28706). The purified fragment was cut with NotI and AgeI and ligated into pTaq8M that had been linearized with NotI and AgeI. JM109 E.coli cells (Promega) were transformed with the ligated products. Clones were tested as described below.

The second mutagenic oligonucleotide (used in a separate reaction) 535-054-02: 5'-caa aag acc ggt aag cgc (tcc acc agc gcc gcc gtc ctg gag) gcc ctc cgc gag gcc cac-3' (SEQ ID NO:197) was used in conjunction with 330-06-03: 5'-GTC GAC TCT AGA TCA GTG GTG GTG GTG GTG GTG CTT GGC CGC CCG GCG CAT C-3' (SEQ ID NO:198) to install random residues from amino acid 513–520. The bases within the parenthesis of primer 535-054-02 are also 91% wild-type and 3% each of the other 3 nucleotides.

To generate mutations in the region 513–520, primer 535-054-02 and primer 535-054-02 were used in a PCR reaction with Taq DN RX HT W417L/G418K/G504K/ E507Q/H784A (SEQ ID NO:177) as template, as described above. The resulting PCR fragment was purified as above and cut with the restriction enzymes AgeI and BamHI. The cut fragment was then ligated into the Taq8M construct, also linearized with AgeI and BamHI. JM109 E.coli cells were transformed with the ligated products. Clones were tested as described Example 1. Mutants developed from these include: Taq DN RX HT W417L/G418K/G499R/A502K/ K504N/E507K/H784A (M1-13) (DNA sequence SEQ ID NO:199; amino acid sequence SEQ ID NO:200). Taq DN RX HT W417L/G418K/G499R/L500I/A502K/G504K/ Q507H/H784A (M1-36) (DNA sequence SEQ ID NO:201; amino acid sequence SEQ ID NO:202). Taq DN RX HT W417L/G418K/G499R/A502K/I503L/G504K/E507K/ T514S/H784A (M2-24) (DNA sequence SEQ ID NO:203; amino acid sequence SEQ ID NO:204). Taq DN RX HT W417L/G418K/G499R/A502K/I503L/G504K/E507K/ V518L/H784A (M2-06) (DNA sequence SEQ ID NO:205; amino acid sequence SEQ ID NO:206).

2. TthDN RX HT H786A Random Mutagenesis

To generate mutants in the helix-hairpin-helix region of the TthDN RX HT H786A (SEQ ID NO:163) enzyme, two different PCR reactions were performed using the H786A (SEQ ID NO:162) mutant as a template. The two PCR products overlap such that a recombinant PCR reaction can be performed (Higuchi, in PCR Technology, H. A. Erlich, ed., Stockton Press, New York. pp61–70 [1989]). This final PCR product is then exchanged with the homologous region of the TthDN H786A mutant by using restriction enzyme sites located on the ends of the fragment and within the TthDN H786A sequence.

Starting with TthDN H786A discussed above, and using primer 604-08-06: 5'-gtc gga ggg gtc ccc cac gag-3' (SEQ ID NO:207) and primer 390-76-08: 5'-tgt gga att gtg agc gg (SEQ ID NO:208), a 620 base pair PCR fragment was generated. PCR reactions were performed using the Advantage cDNA PCR kit (Clontech) according to manufacturer's instructions. This PCR product includes amino acids 1–194. No mutations were introduced via this reaction, however the restriction enzyme site EcoRI is present at the 5' end.

Starting with TthDN RX HT H786A discussed above, and using mutagenic primer 604-08-05: 5'-ctc gtg ggg gac cc tcc gac aac ctc (ccc ggg gtc aag ggc atc ggg gag aag acc gcc) ctc aag ctt ctc aag-3' (SEQ ID NO:209) and primer 209-74-02: 5'-gtg gcc tcc ata tgg gcc agg ac-3' (SEQ ID NO:210) a 787 base pair PCR fragment was generated. PCR reactions were done as above. This fragment does contain random mutations, due to the presence of the mutagenic primer, 604-08-05. The bases within the parenthesis of this primer were synthesized such that 91% of the sequence is wild-type, while the additional 9% is evenly divided between the remaining 3 bases.

The two PCR fragments overlap, and were combined in a recombinant PCR reaction. Primers 390-76-08 and 209-74-02 were added, and the Advantage cDNA PCR kit (Clontech) was again used according to manufacturer's instructions. A 1380 base pair product was generated from this reaction.

The recombinant PCR product was cut with the restriction enzymes EcoRI and NotI according to the manufacturer's instructions to yield a 986 base pair fragment. TthDN RX HT H786A was prepared by cutting with the same enzymes. The fragment was then ligated into the vector, and transformed into JM109 cells. New mutants developed from this set of reactions include:

TthDN RX HT H786A/P197R/K200R (DNA sequence SEQ ID NO:211; amino acid sequence SEQ ID NO:212).
TthDN RX HT H786A/K205Y (DNA sequence SEQ ID NO:213; amino acid sequence SEQ ID NO:214).
TthDN RX HT H786A/G203R (DNA sequence SEQ ID NO:215; amino acid sequence SEQ ID NO:216).

3. Construction of Taq DN RX HT W417L/G418K/H784A L109F/A110T/G499R/A502K/I503L/G504K/E507K/ T514S (Taq SS)

Starting with Taq DN RX HT W417L/G418K/G499R/ A502K/I503L/G504K/E507K/T514S/H784A (SEQ ID NO:203) mutant described above, primer 473-087-05: 5'-cgg gac ctc gag gcg cgt gaa cce cag gag gtc cac-3' (SEQ ID NO:219) was used in conjunction with the appropriate selection primer in a site specific mutagenesis reaction to incorporate the L109F and A110T mutations to generate this enzyme, termed "TaqSS" (DNA sequence SEQ ID NO:217; amino acid sequence SEQ ID NO:218).

4. Construction of Taq DN RX HT W417L/G418L/H784A P88E/P90E/G499R/A502K/A503L/G504K/E507K/T514S Starting with Taq DN RX HT W417L/G418K/G499R/ A502K/A503L/G504K/E507K/T514S/H784A (SEQ ID NO:203) mutant described above, primer 473-087-03: 5'-ccg ggg aaa gtc ctc ctc cgt ctc ggc ccg gcc cgc ctt-3' (SEQ ID NO:222) was used in conjunction with the appropriate selection primer in a site specific mutagenesis reaction to incorporate the P88E and P90E mutations to generate this enzyme (DNA sequence SEQ ID NO:220; amino acid sequence SEQ ID NO:221).

5. TaqSS Random Mutagenesis

Random mutagenesis was used to introduce additional changes in the helix-hairpin-helix domain of the TaqSS mutant (SEQ ID NO:217). The mutagenesis was done as described in example 9 above. In the first step, two different but overlapping PCR products were generated. One of the PCR products, generated with oligos 390-76-08 (SEQ ID NO:208), and 604-08-04: 5'-gtc gga ctc gtc acc ggt cag ggc-3' (SEQ ID NO:223) incorporates the EcoRI site into the fragment, but does not incorporate any mutations. The second PCR product utilizes mutagenic primer 604-08-03: 5'-ctg acc ggt gac gag tcc gac aac ctt (ccc ggg gtc aag ggc atc ggg gag aag acg gcg) agg aag ctt ctg gag-3' (SEQ ID NO:224) and primer 209-74-02 (SEQ ID NO:210). This fragment contains random point mutations, and when combined via recombinant PCR with the first fragment, can be cut with the restriction enzymes EcoRI and NotI, and ligated into the TaqSS construct, also cut with EcoRI and NotI. The ligated construct was then transformed into JM109. Colo nies were screened as described below. Enzymes developed from this mutagenesis include:

TaqSS K198N (DNA sequence SEQ ID NO:225; amino acid sequence SEQ ID NO:226).
TaqSS A205Q (DNA sequence SEQ ID NO:227; amino acid sequence SEQ ID NO:228).
TaqSS I200M/A205G (DNA sequence SEQ ID NO:229; amino acid sequence SEQ ID NO:230).
TaqSS K203N (DNA sequence SEQ ID NO:231; amino acid sequence SEQ ID NO:232).
TaqSS T204P (DNA sequence SEQ ID NO:233; amino acid sequence SEQ ID NO:234).

6. Construction of TaqSS R677A

To generate enzymes with sequence changes in both the arch region and in the polymerase region, additional specific point mutations were generated in TaqSS. Site specific mutagenesis was performed as described above using the oligo 473-060-10: 5'-tag ctc ctg gga gag ggc gtg ggc cga cat gcc-3' (SEQ ID NO:237) to generate the TaqSS R677A mutant (DNA sequence SEQ ID NO:235; amino acid sequence SEQ ID NO:236).

7. Construction of TaqTthAKK (DNA Sequence SEQ ID NO:238; Amino Acid Sequence SEQ ID NO:239) and TthTaqSM (DNA Sequence SEQ ID NO:240; Amino Acid Sequence SEQ ID NO:241)

Chimeric mutant TaqTthAK and TthTaq5M were generated by cutting Tth DN RX HT (H786A/G506K/Q509K) (SEQ ID NO:165; here abbreviated TthAKK) or Taq 4M G504 (SEQ ID NO:177; here abbreviated Taq 5M) with the restriction endonucleases EcoRI and NotI. The smaller insert fragments as well as the larger vector fragments were gel purified as detailed in Example 3D, and the insert fragments were exchanged between the two mutants and ligated as described in Example 3D. Screening and verification of the construct sequence was also done as in Example 3D.

EXAMPLE 8

Improvement of RNA-dependent 5' Nuclease Activity in Other Polymerases

Information gained from the TaqPol/TthPol recombinations, mutagenesis and modeling, was used to make comparable mutations in additional DNA polymerases and examined the effects on the cleavage activities of these enzymes. The DNA polymerases of *Thermus filiformis* (TfiPol) and *Thermus scotoductus* (TscPol) were cloned and purified as described in Example 2. The mutagenesis of these two proteins is described below.

A. Construction of TfiPolDN2M

Mutagenesis of pTrc99a-TfiPol (SEQ ID NO:48) was done using the QuikChange site-directed mutagenesis kit (Stratagene) according to the manufacturer's protocol. The P420K mutation was made with the following two oligonucleotides; 5'-CTTCCAGAACCTCTTTAAACGGCT TCCGAGAAG (SEQ ID NO:244) and 5'-CTTCTCGGAAAGCCGTTTAAAGAGGTTCTGGAAG (SEQ ID NO:245). The E507Q mutation was made with the following two oligonucleotides; 5'-CCGGTG GGCCG-GACGCAGAAGACGGGCAAGC (SEQ ID NO:246) and 5'-GCTTGCCCGTCTTCTGCGTCCGGCCCACCGG (SEQ ID NO:247). The D785N mutation was made with the following two oligonucleotides; 5'-CTCCTC CAAGTGCA-CAACGAGCTGGTCCTGG (SEQ ID NO:248) and 5'-CCAGGACCAGCTCGTTGTGCACTTGGAGGAG (SEQ ID NO:249). The plasmid containing all three mutations is called pTrc99a-TfiPolDN2M, (DNA sequence SEQ ID NO:242; amino acid sequence SEQ ID NO:243).

B. Construction of TscPolDN2M

Mutagenesis of pTrc99a-TscPol (SEQ ID NO:51) was done with the QuikChange site-directed mutagenesis kit (Stratagene) according to the manufacturer's protocol. The E416K mutation was made with the following two oligonucleotides; 5'-GCCGCCCTCCTGAAGCGGCTTAAGGG (SEQ ID NO:252) and 5'-CCCTTAAGCCGC TTCAG-GAGGGCGGC (SEQ ID NO:253). The E505Q mutation was made with the following two oligonucleotides; 5'-ATCGGCAAGACGCAGAAGACGGGCAAGC (SEQ ID NO:254) and 5'-GCTTGCCCGTCTT CTGCGTCT-TGCCGAT (SEQ ID NO:255). The D783N mutation was made with the following two oligonucleotides; 5'-TTGCAGGTGCACAACGAACTGGTCCTC (SEQ ID NO:256) and 5'-GAGGACCAGTTCGTT GTGCACCTG-CAA (SEQ ID NO:257). The plasmid containing all three mutations is called pTrc99a-TscPolDN2M, (DNA sequence SEQ ID NO:250; amino acid sequence SEQ ID NO:251).

C. Chimerics of Tse, Tfi, Tth and Taq Mutants

1. Construction of TfiTth AKK (DNA Sequence SEQ ID NO:258; amino acid Sequence SEQ ID NO:259), TscT-thAKK (DNA Sequence SEQ ID NO:260; amino acid Sequence SEQ ID NO:261), TfiTaq5M (DNA Sequence SEQ ID NO:262; amino acid Sequence SEQ ID NO:263) and TscTaq5M (DNA Sequence SEQ ID NO:264; amino acid Sequence SEQ ID NO:265)

To generate chimeric enzymes between Tth DN RX HT (H86A/G506K/Q509K) (here abbreviated TthAKK, SEQ ID NO:165) or Taq 4M G504 (here abbreviated Taq 5M, SEQ ID NO:177), and Tfi DN 2M (SEQ ID NO:242), or Tsc DN 2M (SEQ ID NO:250), additional restriction endonuclease sites were introduced by site specific mutagenesis into the named Tfi and Tsc mutants. Mutagenic primers 700-011-01 5'-cag acc atg aat tcc acc cca ctt ttt gac ctg gag-3' (SEQ ID NO:275) and 700-011-02 5'-gtg gac gcg gcc gcc cga ggc cgc cgc cag ggc cag-3' (SEQ ID NO:276) were used to introduce an EcoRI site at amino acid position 1 and a NotI site at amino acid position 331 in Tfi DN 2M. Mutagenic primers 700-011-03 5'-cag acc atg aat tcc ctg ccc ctc ttt gag ccc aag-3' (SEQ ID NO:277) and 700-011-04 5'-gta aac cgc gcc gcc cca ggc ggc ggc caa ggc gtt-3' (SEQ ID NO:278) were used to introduce an EcoRI site at amino acid position 1 and a NotI site at amino acid position 327 in Tsc DN 2M. PCR reactions were done using the Advance cDNA PCR kit (Clonetech) according to manufacturer's instructions and either Tfi DN 2M or Tsc DN 2M as target, with their corresponding primers. The 1017 base pair PCR products were cut with both EcoRI and NotI to yield 993 base pair insert fragments that were gel purified as described in Example 3D. The mutants Taq4M G504K (SEQ ID NO:177) and Tth DN RX HT (H786A/G506K/Q509K) (SEQ ID NO:165) were also cut with EcoRI and NotI, and the larger, vector fragment was gel isolated as above. Ligations were performed as detailed in Example 3D, as was the screening and verification of the new constructs.

TABLE 1

| Klenow | Kcat (s⁻¹) | Km (dNTP) (μM) | Kd (nM) | Relative DNA affinity | Reference | Taq Pol |
|---|---|---|---|---|---|---|
| Wild-Type | 2.4 | 2.8 | 8 | 1 | 2 | Wild-Type |
| S610A | n.d. | — | n.d. | — | 5 | S515 |
| R668A | 0.006 | 6.5 | 140, 150 | 0.06, 0.05 | 1, 2 | R573* |
| N678A | n.d. | — | n.d. | — | 5 | N583 |
| E710A | 0.1 | 15 | 250 | 0.03 | 2 | E615* |
| E710D | 1.7 | 7.7 | 110 | 0.07 | 2 | E615* |
| K758A | 0.131 | 15.6 | — | 0.63 | 4 | K663 |
| K578R | 2.0 | 2.1 | — | 1.125 | 4 | K663 |
| Y766S | 0.8 | 6.4 | 13 | 0.4, 0.6 | 1, 2 | Y671 |
| R841A | 0.2 | 9.8 | 40, 53 | 0.2 | 1, 2 | R746* |
| N845A | 1.0 | 23 | 8, 5 | 1.0, 1.7 | 1, 2 | N750* |
| N845Q | 0.03 | 1.7 | 80, 55 | 0.1, 0.2 | 1, 2 | N750* |
| Q849A | 0.02 | 3.8 | 100, 160 | 0.08, 0.05 | 1, 2 | Q754 |
| Q849E | 0.001 | n.d. | 90, 91 | 0.09 | 1, 2 | Q754 |
| H881A | 0.3 | 3.3 | 20, 28 | 0.4, 0.3 | 1, 2 | H784* |
| D882N | <0.0001 | n.d. | 30 | 0.6 | 2 | D785 |
| D882S | 0.001 | 7.5 | 0.9 | 9 | 2 | D785 |

References:
1. JBC (1990) 265: 14579–14591
2. JBC (1992) 267: 8417–8428
3. Eur. J. Biochem (1993) 214: 59–65
4. JBC (1994) 269: 13259–13265
5. Nature (1996) 382: 278–281

TABLE 2

Rational mutations in the polymerase region

A. DNA activity table

| | IdT | % Tth | % Taq4M | HP | X |
|---|---|---|---|---|---|
| Tth DN RX HT | 31.91 | 100% | 83% | 3.81 | 101.9 |
| Tth DN RX HT H641A | 23.61 | 74% | 62% | 5.32 | 221.24 |
| Tth DN RX HT R748A | 22.1 | 69% | 58% | 4.39 | 88.17 |
| Tth DN RX HT H786A | 34.31 | 108% | 90% | 7.75 | 185.35 |
| Tth DN RX HT H786A/G506K/Q509K (AKK) | 32.1 | 101% | 84% | 5.7 | 332.8 |
| Taq DN RX HT W417L/G418K/E507Q/H784A (Taq 4M) | 38.23 | 120% | 100% | 68.21 | 1100.18 |
| Taq 4M G504K | 36.04 | 113% | 94% | 31.76 | 417.40 |
| Taq 4M H639A | 42.95 | 135% | 112% | 91.46 | 2249.67 |
| Taq 4M R587A | 44.78 | 140% | 117% | 143.0 | 252.69 |
| Taq DN RX HT W417L/G418K/G499R/A502K/I503L/K504N/E07K/H784A (Taq8M) | 43.95 | 138% | 115% | 122.53 | 346.56 |
| TaqSS R677A | 32.3 | 101% | 84% | 206.9 | 2450.0 |

B. RNA activity table

| | IrT1 | % Tth | % Taq4M |
|---|---|---|---|
| Tth DN RX HT | 0.89 | 100% | 34% |
| Tth DN RX HT H641A | 1.18 | 133% | 45% |
| Tth DN RX HT R748A | 1.34 | 151% | 51% |
| Tth DN RX HT H786A | 1.31 | 147% | 49% |
| Tth DN RX HT H786A/G506K/Q509K (AKK) | 1.59 | 179% | 60% |
| Taq DN RX HT W417L/G418K/E507Q/H784A (Taq 4M) | 2.65 | 298% | 100% |
| Taq 4M G504K | 2.76 | 310% | 114% |
| Taq 4M H639A | 3.89 | 437% | 147% |
| Taq 4M R587A | 3.13 | 352% | 118% |
| Taq DN RX HT W417L/G418K/G499R/A502K/I503L/K504N/E07K/H784A (Taq8M) | 4.00 | 450% | 151% |
| TaqSS R677A | 2.22 | 249% | 84% |

TABLE 3

Rational arch mutations

DNA activity table

| | IdT | % Tth | % Taq4M | HP | X |
|---|---|---|---|---|---|
| Taq 4M P88E/P90E | 10.20 | 32% | 27% | 2.00 | 97.00 |
| Taq 4M G80E | 26.30 | 82% | 69% | 103.6 | 2900 |
| Taq 4M L109F/A110T | 36.45 | 114% | 95% | 19.71 | 749.69 |

RNA activity table

| | IrT1 | % Tth | % Taq4M |
|---|---|---|---|
| Taq 4M P88E/P90E | 0.10 | 11% | 4% |
| Taq 4M G80E | 3.11 | 349% | 117% |
| Taq 4M L109F/A110T | 2.45 | 275% | 92% |

TABLE 4

Arch/thumb combinations

DNA activity table

| | IdT | % Tth | % Taq4M | HP | X |
|---|---|---|---|---|---|
| Taq W417L/G418K/E507K/H784A/L109F/A110T/G499R/A502K/I503L/G504K/E507K/T514S (Taq SS) | 63.33 | 198% | 166% | 177.05 | 202.32 |
| Taq P88E/P90E/W417L/G418K/G499R/A502K/I503L/G504K/E507K/T514S/H784A | 36.48 | 114% | 95% | 9.44 | 70.35 |

RNA activity table

| | IrT1 | % Tth | % Taq4M |
|---|---|---|---|
| Taq W417L/G418K/E507K/H784A/L109F/A110T/G499R/A502K/I503L/G504K/E507K/T514S (Taq SS) | 3.16 | 355% | 119% |
| Taq P88E/P90E/W417L/G418K/G499R/A502K/I503L/G504K/E507K/T514S/H784A | 0.22 | 25% | 8% |

TABLE 5

Helix-hairpin-helix random mutagenesis

DNA activity table

| | IdT | % Tth | % Taq4M | HP | X |
|---|---|---|---|---|---|
| TaqSS K198N | 23.4 | 73% | 61% | 25.7 | 1233.1 |
| TaqSS A205Q | 25.6 | 80% | 67% | 13.4 | 699.1 |
| TaqSS T204P | 11.2 | 35% | 29% | 1.9 | 209.4 |
| TaqSS I200M/A205G | 16.8 | 53% | 44% | 7.8 | 597.2 |
| TaqSS K203N | 25.9 | 81% | 68% | 36.6 | 1429.8 |
| Tth DN RX HT H786A/P197R/K200R | 10.7 | 33% | 28% | 3.2 | 66.3 |
| Tth DN RX HT H786A/K205Y | 11.5 | 36% | 30% | 6.1 | 327.5 |
| Tth DN RX HT H786A/G203R | 18.3 | 57% | 48% | 2.1 | 98.8 |

RNA activity table

| | IrT1 | % Tth | % Taq4M |
|---|---|---|---|
| TaqSS K198N | 1.22 | 137% | 46% |
| TaqSS A205Q | 0.62 | 70% | 23% |
| TaqSS T204P | 0.36 | 40% | 14% |
| TaqSS I200M/A205G | 0.77 | 87% | 29% |
| TaqSS K203N | 2.09 | 235% | 79% |
| Tth DN RX HT H786A/P197R/K200R | 0.47 | 52% | 18% |
| Tth DN RX HT H786A/K205Y | 0.68 | 77% | 26% |
| Tth DN RX HT H786A/G203R | 1.61 | 180% | 61% |

TABLE 6

Random thumb mutations

DNA activity table

| | IdT | % Tth | % Taq4M | HP | X |
|---|---|---|---|---|---|
| Taq DN RX HT W417L/G418K/E507K/H784A/G499R/A502K/K504N/(M1-13) | 59.96 | 188% | 157% | 133.65 | 907.41 |
| Taq DN RX HT W417L/G418K//H784A/L500I/Q507H A502K/G504K (M1-36) | 46.74 | 146% | 122% | 123.11 | 822.61 |
| Taq DN RX HT W417L/G418K/G499R/A502K/G504K/E507K/H784A/T514S (M2-24) | 85.7 | 269% | 224% | 369.96 | 3752.12 |
| Taq DN RX HT W417L/G418K/G499R/A502K/G504K/E507K/H784A/V518L (M2-06) | 76.7 | 240% | 201% | 355.87 | 2038.19 |

RNA activity table

| | IrT1 | % Tth | % Taq4M |
|---|---|---|---|
| Taq DN RX HT W417L/G418K/E507K/H784A/G499R/A502K/K504N/(M1-13) | 2.55 | 287% | 96% |
| Taq DN RX HT W417L/G418K//H784A/L500I/Q507H A502K/G504K (M1-36) | 2.71 | 304% | 102% |
| Taq DN RX HT W417L/G418K/G499R/A502K/G504K/E507K/H784A/T514S (M2-24) | 4.43 | 498% | 167% |
| Taq DN RX HT W417L/G418K/G499R/A502K/G504K/E507K/H784A/V518L (M2-06) | 3.56 | 400% | 134% |

TABLE 7

Chimeric mutants

A. DNA activity table

| | IdT2 | % TthAKK | HP | X |
|---|---|---|---|---|
| TthAKK | 34.18 | 100% | 5 | 393 |
| Taq 4M G504K | 40.19 | 105% | 28 | 1991 |
| Tfi DN 2M | 36.60 | 106% | 289 | 1326 |
| Tsc DN 2M | 25.49 | 75% | 283 | 2573 |
| TaqTthAKK | 63.89 | 187% | 32 | 1658 |
| TthTaq 4M G504K | 25.03 | 73% | 8 | 627 |
| TfiTthAKK | 34.13 | 100% | 15 | 459 |
| TscTthAKK | 35.23 | 103% | 29 | 2703 |
| TfiTaq 4M G504K | 35.69 | 104% | 37 | 872 |
| TscTaq 4M G504K | 30.04 | 88% | 25 | 2008 |

TABLE 7-continued

Chimeric mutants

B. RNA activity table

|  | IrT3 | % TthAKK |
|---|---|---|
| TthAKK | 2.27 | 100% |
| Taq 4M G504K | 2.31 | 102% |
| Tfi DN 2M | 0.20 | 9% |
| Tsc DN 2M | 0.29 | 13% |
| TaqTthAKK | 6.81 | 300% |
| TthTaq 4M G504K | 1.09 | 48% |
| TfiTthAKK | 1.24 | 55% |
| TscTthAKK | 9.65 | 4.25% |
| TfiTaq 4M G504K | 1.05 | 46% |
| TscTaq 4M G504K | 2.95 | 130% |

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention which are obvious to those skilled in the relevant fields are intended to be within the scope of the following claims.

SEQUENCE LISTING (278 sequences)

SEQ ID NO: 1 - DNA, 2506 bp, Thermus aquaticus
atgagggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccagggggggccgggtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttccaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccacatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggagtgataccacc

SEQ ID NO: 2 - DNA, 2496 bp, thermus flavus
atggcgatgcttcccctctttgagcccaaaggccgcgtgctcctggtggacggccaccacctggcctaccgcaccttctttgccctcaagggcctcaccaccagccgcggcgaacccgttcaggcggtctacggcttcgccaaaagcctcctcaaggccctgaaggaggacggggacgtggtggtggtggtctttgacgccaaggccccctccttccgccacgaggcctacgaggcctacaaggcgggccgggcccccaccccggaggactttccccggcagctggccctcatcaaggagttggtggacctcctaggccttgtgcggctggaggttcccggctttgaggcggacgacgtgctggccaccctggccaagcgggcggaaaaggaggggtacgaggtgcgcatcctcactgccgaccgcgacctctaccagctcctttcggagcgcatcgccatcctccaccctgaggggtacctgatcaccccggcgtggctttacgagaagtacggcctgcgcccggagcagtgggtggactaccgggccctggcgggggacccctcggataacatccccggggtgaagggcatcggggagaagaccgcccagaggctcatccgcgagtgggggagcctggaaaacctcttccagcacctggaccaggtgaagccctccttgcgggagaagctccaggcgggcatggaggccctggccctttcccggaagctttcccaggtgcacactgacctgcccctggaggtggacttcgggaggcgccgcacacccaacctggagggtctgcgggcttttttggagcggttggagtttggaagcctcctccacgagttcggcctcctggaggggccgaaggcggcagaggaggccccctggccccctccggaaggggcttttttgggcttttccttttcccgtcccgagcccatgtgggccgagcttctggccctggctggggcgtgggaggggcgcctccatcgggcacaagacccccttaggggcctgagggaccttaagggggtgcggggaatcctggccaaggacctggcggttttggccctgcgggagggcctggacctcttcccagaggacgaccccatgctcctggcctaccttctggacccctccaacaccacccctgagggggtggcccggcgttacgggggggagtggacggaggatgcgggggagagggccctcctggccgagcgcctcttccagaccctaaaggagcgccttaagggagaagaacgcctgctttggctttacgaggaggtggagaagccgctttcccgggtgttggcccggatggaggccacgggggtccggctggacgtggcctacctccaggccctctccctggaggtggaggcggaggtgcgccagctggaggaggaggtcttccgcctggccggccaccccttcaacctcaactcccgcgaccagctggagcgggtgctctttgacgagctgggcctgcctgccatcggcaagacggagaagacggggaaacgctccaccagcgctgccgtgctggaggccctgcgagaggcccaccccatcgtggaccgcatcctgcagtaccgggagctcaccaagctcaagaacacctacatagaccccctgcccgccctggtccaccccaagaccggccggctccacacccgcttcaaccagacggccaccgccacgggcaggctttccagctccgaccccaacctgcagaacatccccgtgcgcacccctctgggccagcgcatccgccgagccttcgtggccgaggagggctgggtgctggtggtcttggactacagccagattgagcttcgggtcctggcccacctctccggggacgagaacctgatccgggtctttcaggaggggagggacatccacacccagaccgccagctggatgttcggcgtttcccccgaaggggtagaccctctgatgcgccgggcggccaagaccatcaacttcggggtgctctacggcatgtccgcccaccgcctctccggggagctttccatcccctacgaggaggcggtggccttcattgagcgctacttccagagctaccccaaggtgcgggcctggattgaggggaccctcgaggagggccgccggcgggggtatgtggagaccctcttcggccgccggcgctatgtgcccgacctcaacgcccgggtgaagagcgtgcgcgaggcggcggagcgcatggccttcaacatgccggtccagggcaccgccgccgacctcatgaagctggccatggtgcggcttttcccccggcttcaggaactgggggcgaggatgcttttgcaggtgcacgacgagctggtcctcgaggcccccaaggaccgggcggagagggtagccgctttggccaaggaggtcatggagggggtctggcccctgcaggtgcccctggaggtggaggtgggcctgggggaggactggctctccgccaaggagtag

SEQ ID NO: 3 - DNA, 2511 bp, Thermus thermophilus
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 4 - protein, 832 aa, Thermus aquaticus [sequence omitted]

SEQ ID NO: 5 - protein, 831 aa, thermus flavus
MAMLPLFEPKGRVLLVDGHHLAYRTFFALKGLTTSRGEPVQAVYGFAKSLLKALKEDGDVVVVVFDAKAPSFRHEAYEAYKAGRAPTPEDFPRQLALIKELVDLLGLVRLEVPGFEADDVLATLAKRAEKEGYEVRILTADRDLYQLLSERIAILHPEGYLITPAWLYEKYGLRPEQWVDYRALAGDPSDNIPGVKGIGEKTAQRLIREWGSLENLFQHLDQVKPSLREKLQAGMEALALSRKLSQVHTDLPLEVDFGRRRTPNLEGLRAFLERLEFGSLLHEFGLLEGPKAAEEAPWPPPEGAFLGFSFSRPEPMWAELLALAGAWEGRLHRAQDPLRGLRDLKGVRGILAKDLAVLALREGLDLFPEDDPMLLAYLLDPSNTTPEGVARRYGGEWTEDAGERALLAERLFQTLKERLKGEERLLWLYEEVEKPLSRVLARMEATGVRLDVAYLQALSLEVEAEVRQLEEEVFRLAGHPFNLNSRDQLERVLFDELGLPAIGKTEKTGKRSTSAAVLEALREAHPIVDRILQYRELTKLKNTYIDPLPALVHPKTGRLHTRFNQTATATGRLSSSDPNLQNIPVRTPLGQRIRRAFVAEEGWVLVVLDYSQIELRVLAHLSGDENLIRVFQEGRDIHTQTASWMFGVSPEGVDPLMRRAAKTINFGVLYGMSAHRLSGELSIPYEEAVAFIERYFQSYPKVRAWIEGTLEEGRRRGYVETLFGRRRYVPDLNARVKSVREAAERMAFNMPVQGTAADLMKLAMVRLFPRLQELGARMLLQVHDELVLEAPKDRAERVAALAKEVMEGVWPLQVPLEVEVGLGEDWLSAKE

SEQ ID NO: 6 - protein, 836 aa, Thermus thermophilus
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 7 - DNA, 2502 bp, Artificial Sequence
  Description of Artificial Sequence:  Synthetic
  misc_feature (4)..(5): n at these positions can be a, c, t, or g.
  misc_feature (181)..(182): n at these positions can be a, c, t, or g.
  misc_feature (190): n at this position can be a, c, t, or g.
  misc_feature (366): n at this position can be a, c, t, or g.
  misc_feature (617): n at this position can be a, c, t, or g.
  misc_feature (628): n at this position can be a, c, t, or g.
  misc_feature (685): n at this position can be a, c, t, or g.
  misc_feature (714): n at this position can be a, c, t, or g.
  misc_feature (722): n at this position can be a, c, t, or g.
  misc_feature (738): n at this position can be a, c, t, or g.
  misc_feature (784): n at this position can be a, c, t, or g.
  misc_feature (1022): n at this position can be a, c, t, or g.
  misc_feature (1029): n at this position can be a, c, t, or g.
  misc_feature (1038): n at this position can be a, c, t, or g.
  misc_feature (1053): n at this position can be a, c, t, or g.
  misc_feature (1098): n at this position can be a, c, t, or g.
  misc_feature (1105): n at this position can be a, c, t, or g.
  misc_feature (1206): n at this position can be a, c, t, or g.
  misc_feature (1227): n at this position can be a, c, t, or g.
  misc_feature (1244): n at this position can be a, c, t, or g.
  misc_feature (1251)..(1253): n at these positions can be a, c, t, or g.
  misc_feature (1350): n at this position can be a, c, t, or g.
  misc_feature (1380): n at this position can be a, c, t, or g.
  misc_feature (1497): n at this position can be a, c, t, or g.
  misc_feature (1530): n at this position can be a, c, t, or g.
  misc_feature (1569): n at this position can be a, c, t, or g.
  misc_feature (1572): n at this position can be a, c, t, or g.
  misc_feature (1641): n at this position can be a, c, t, or g.
  misc_feature (1653): n at this position can be a, c, t, or g.
  misc_feature (1655): n at this position can be a, c, t, or g.
  misc_feature (1770): n at this position can be a, c, t, or g.
  misc_feature (1812): n at this position can be a, c, t, or g.
  misc_feature (2319): n at this position can be a, c, t, or g.
  misc_feature (2346): n at this position can be a, c, t, or g.
  misc_feature (2396): n at this position can be a, c, t, or g.
atgnnggcgatgcttcccctctttgagcccaaaggccgggtcctcctggtggacggccaccacctggcctaccgcaccttcttcgccctgaagggcctcaccaccagccggggcgaaccggtgcaggcggtctacggcttcgccaagagcctcctcaaggccctgaaggaggacggggacnnggcggtgntcgtggtctttgacgccaaggccccctccttccgccacgaggcctacgaggcctacaaggcgggccgggcccccaccccggaggactttccccggcagctcgccctcatcaaggagctggtggacctcctggggcttgcgcgcctcgaggtccccggctacgaggcggacgacgtnctggccaccctggccaagaaggcggaaaaggaggggtacgaggtgcgcatcctcaccgccgaccgcgacctctaccagctcctttccgaccgcatcgccgtcctccaccccgaggggtacctcatcaccccggcgtggctttgggagaagtacggcctgaggccggagcagtgggtggactaccgggccctggcgggggacccctccgacaacctccccggggtcaagggcatcggggagaagaccgcccngaagctcctcnaggagtgggggagcctggaaaacctcctcaagaacctggaccgggtgaagcccgccntccgggagaagatccaggcccacatggangacctgangctctcctgggagctntcccaggtgcgcaccgacctgcccctggaggtggacttcgccaagnggcgggagcccgaccgggaggggcttagggcctttctggagaggctggagtttggcagcctcctccacgagttcggcctcctggagggccccaaggccctggaggaggccccctggcccccgccggaaggggccttcgtgggctttgtcctttcccgccccgagcccatgtgggccgagcttctggccctggccgccgccagggagggccgggtccaccgggcaccagacccctttangggcctnagggacctnaaggaggtgcggggnctcctcgccaaggacctggccgttttggccctgagggagggcctngacctcntgcccggggacgaccccatgctcctcgcctacctcctggacccctccaacaccacccccgagggggtggcccggcgctacgggggggagtggacggaggangcgggggagcgggccctcctntccgagaggctcttccngaacctnnngcagcgccttgagggggaggagaggctcctttggctttaccaggaggtggagaagcccctttcccgggtcctggcccacatggaggccacgggggtncggctggacgtggcctacctccaggccctntccctggaggtggcggaggagatccgccgcctcgaggaggaggtcttccgcctggccggccaccccttcaacctcaactcccgggaccagctggaaagggtgctctttgacgagctngggcttcccgccatcggcaagacggagaagacnggcaagcgctccaccagcgccgccgtgctggaggccctncgngaggcccaccccatcgtggagaagatcctgcagtaccgggagctcaccaagctcaagaacacctacatngaccccctgccngncctcgtccaccccaggacgggccgcctccacacccgcttcaaccagacggccacggccacgggcaggcttagtagctccgaccccaacctgcagaacatccccgtccgcaccccnctgggccagaggatccgccgggccttcgtggccgaggagggntgggtgttggtggccctggactatagccagatagagctccgggtcctggcccacctctccggggacgagaacctgatccgggtcttccaggaggggagggacatccacacccagaccgccagctggatgttcggcgtccccccggaggccgtggaccccctgatgcgccgggcggccaagaccatcaacttcggggtcctctacggcatgtccgcccaccgcctctcccaggagcttgccatcccctacgaggaggcggtggccttcattgagcgctacttccagagcttccccaaggtgcgggcctggattgagaagaccctggaggagggcaggaggcgggggtacgtggagaccctcttcggccgccggcgctacgtgcccgacctcaacgcccgggtgaagagcgtgcgggaggcggcggagcgcatggccttcaacatgcccgtccagggcaccgccgccgacctcatgaagctggccatggtgaagctcttcccccggctncaggaaatgggggccaggatgctcctncaggtccacgacgagctggtcctcgaggcccccaaagagcgggcggaggnggtggccgctttggccaaggaggtcatggagggggtctatcccctggccgtgcccctggaggtggaggtggggatgggggaggactggctctccgccaaggagtag

SEQ ID NO: 8 - protein, 833 aa, Artificial Sequence
  Description of Artificial Sequence:  Synthetic
  SITE (2): Xaa at this position can be any amino acid.
  SITE (63): Xaa at this position can be any amino acid.
  SITE (109): Xaa at this position can be any amino acid.
  SITE (186): Xaa at this position can be any amino acid.
  SITE (205): Xaa at this position can be any amino acid.
  SITE (209): Xaa at this position can be any amino acid.
  SITE (227)..(228): Xaa at these positions can be any amino acid.
  SITE (233): Xaa at this position can be any amino acid.
  SITE (240): Xaa at this position can be any amino acid.
  SITE (243)..(244): Xaa at these positions can be any amino acid.
  SITE (247): Xaa at this position can be any amino acid.
  SITE (260): Xaa at this position can be any amino acid.
  SITE (290): Xaa at this position can be any amino acid.
  SITE (329): Xaa at this position can be any amino acid.
  SITE (336): Xaa at this position can be any amino acid.
  SITE (340): Xaa at this position can be any amino acid.
  SITE (368): Xaa at this position can be any amino acid.
  SITE (414): Xaa at this position can be any amino acid.
  SITE (417)..(418): Xaa at these positions can be any amino acid.
  SITE (431): Xaa at this position can be any amino acid.
  SITE (551): Xaa at this position can be any amino acid.
  SITE (605): Xaa at this position can be any amino acid.
  SITE (773): Xaa at this position can be any amino acid.
  SITE (794): Xaa at this position can be any amino acid.
  SITE (798): Xaa at this position can be any amino acid.
  SITE (823): Xaa at this position can be any amino acid.
  SITE (833): Xaa at this position can be any amino acid.
MXAMLPLFEPKGRVLLVDGHHLAYRTFFALKGLTTSRGEPVQAVYGFAKSLLKALKEDGDAVXVVFDAKAPSFRHEAYEAYKAGRAPTPEDFPRQLALIKELVDLLGLXRLEVPGYEADDVLATLAKKAEKEGYEVRILTADRDLYQLLSDRIAVLHPEGYLITPAWLWEKYGLRPEQWVDYRALXGDPSDNLPGVKGIGEKTAXKLLXEWGSLENLLKNLDRVKPXXREKIXAHMEDLXLSXXLSXVRTDLPLEVDFAXRREPDREGLRAFLERLEFGSLLHEFGLLEXPKALEEAPWPPPEGAFVGFVLSRPEPMWAELLALAAARXGRVHRAXDPLXGLRDLKEVRGLLAKDLAVLALREGLDLXPGDDPMLLAYLLDPSNTTPEGVARRYGGEWTEDAGERALLSERLFXNLXXRLEGEERLLWLYXEVEKPLSRVLAHMEATGVRLDVAYLQALSLEVAEEIRRLEEEVFRLAGHPFNLNSRDQLERVLFDELGLPAIGKTEKTGKRSTSAAVLEALREAHPIVEKILQYRELTKLKNTYIDPLPXLVHPRTGRLHTRFNQTATATGRLSSSDPNLQNIPVRTPLGQRIRRAFVAEEGWXLVALDYSQIELRVLAHLSGDENLIRVFQEGRDIHTQTASWMFGVPPEAVDPLMRRAAKTINFGVLYGMSAHRLSQELAIPYEEAVAFIERYFQSFPKVRAWIEKTLEEGRRRGYVETLFGRRRYVPDLNARVKSVREAAERMAFNMPVQGTAADLMKLAMVKLFPRLXEMGARMLLQVHDELVLEAPKXRAEXVAALAKEVMEGVYPLAVPLEVEVGXGEDWLSAKEX

SEQ ID NO: 9 - DNA, 53 bp, Artificial Sequence
  Description of Artificial Sequence:  Synthetic
uucgcuuucuucccuuccuuucucgccacguucgccggcuuuccccgucaagc

SEQ ID NO: 10 - DNA, 30 bp, Artificial Sequence
  Description of Artificial Sequence:  Synthetic
acggggaaagccggcgaacgtggcgagaaa

SEQ ID NO: 11 - DNA, 26 bp, Artificial Sequence
  Description of Artificial Sequence:  Synthetic
attagaaaggaagggaagaaagcgaa

SEQ ID NO: 12 - DNA, 30 bp, Artificial Sequence
  Description of Artificial Sequence:  Synthetic
acggggaaagccggcgaacgtggcgagaac

SEQ ID NO: 13 - DNA, 30 bp, Artificial Sequence
  Description of Artificial Sequence:  Synthetic
cttgacggggaaagccggcgaacgtggcgc

SEQ ID NO: 14 - DNA, 23 bp, Artificial Sequence
  Description of Artificial Sequence:  Synthetic
agaaaggaagggaagaaagcgaa

SEQ ID NO: 15 - DNA, 27 bp, Artificial Sequence
  Description of Artificial Sequence:  Synthetic
agggagaaggcaactggaccgaaggcc

SEQ ID NO: 16 - DNA, 34 bp, Artificial Sequence
  misc_feature (1): The residue at this position is linked to a spacer containing a fluorescein label.
  modified_base (34): The residue at this position can be a, c, t, or g; the 3' end is modified with a dideoxynucleotide.; Description of Artificial Sequence:  Synthetic
cgaaattaatacgcttgtggagaaggagttcatn

SEQ ID NO: 17 - DNA, 640 bp, Artificial Sequence
  Description of Artificial Sequence:  Synthetic
gggagcccagcuaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcuguccagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuuc

SEQ ID NO: 18 - DNA, 53 bp, Artificial Sequence
  Description of Artificial Sequence:  Synthetic
gctatgaactccttctccacaagcgccttcggtccagttgccttctccctggg

SEQ ID NO: 19 - protein, 214 aa, Artificial Sequence
  Description of Artificial Sequence:  Synthetic
DPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRI

SEQ ID NO: 20 - protein, 214 aa, Artificial Sequence
  Description of Artificial Sequence:  Synthetic
DPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRI

SEQ ID NO: 21 - DNA, 14 bp, Artificial Sequence
  misc_feature (1): The residue at this position is linked to a fluorescein label.
  misc_feature (4): The residue at this position is linked to a spacer containing a Cy3 abasic linker group.; Description of Artificial Sequence:  Synthetic
cgcttctcgctcgc

SEQ ID NO: 22 - DNA, 18 bp, Artificial Sequence
  Description of Artificial Sequence:  Synthetic
acggaacgagcgtctttg

SEQ ID NO: 23 - DNA, 32 bp, Artificial Sequence
  Description of Artificial Sequence:  Synthetic
gcgagcgagacagcgaaagacgcucguuccgu

SEQ ID NO: 24 - DNA, 32 bp, Artificial Sequence
  Description of Artificial Sequence:  Synthetic
gcgagcgagacagcgaaagacgctcgttccgt

SEQ ID NO: 25 - DNA, 29 bp, Artificial Sequence
  Description of Artificial Sequence:  Synthetic
acggaacgagcgtctttcatctgtcaatc

SEQ ID NO: 26 - DNA, 16 bp, Artificial Sequence
  misc_feature (1): The residue at this position is linked to a tetrachlorofluorescein.; Description of Artificial Sequence:  Synthetic
ttttcaactgccgtga

SEQ ID NO: 27 - DNA, 37 bp, Artificial Sequence
  Description of Artificial Sequence:  Synthetic
  modified_base (1): The residue at this position can be a, c, t, or g, and is modified with a biotin-streptavitin complex.
nucacggcaguuggugcgccucggaacgaggcgcacg

SEQ ID NO: 28 - DNA, 36 bp, Artificial Sequence
  Description of Artificial Sequence:  Synthetic
tcacggcagttggtgcgcctcggaacgaggcgcacg

SEQ ID NO: 29 - DNA, 30 bp, Artificial Sequence
  modified_base (30): The residue at this position can be a, c, t, or g, is  modified with an amine moiety.; Description of Artificial Sequence:  Synthetic
cggaggaagcagttggtgcgcctcgttaan

SEQ ID NO: 30 - DNA, 22 bp, Artificial Sequence
  misc_feature (1): The residue at this position is linked to a fluorescein label.; Description of Artificial Sequence:  Synthetic
tccttctcaactgcttcctccg

SEQ ID NO: 31 - DNA, 28 bp, Artificial Sequence
  modified_base (28): The residue at this position can be a, c, t, or g, and is modified with a biotin moiety.; Description of Artificial Sequence:  Synthetic
aacgaggcgcacctcaaatctccctttn

SEQ ID NO: 32 - DNA, 16 bp, Artificial Sequence
  misc_feature (1): The residue at this position is linked to a fluorescein label.; Description of Artificial Sequence:  Synthetic
ttttcgctgtctcgct

SEQ ID NO: 33 - DNA, 13 bp, Artificial Sequence
  Description of Artificial Sequence:  Synthetic
acgagcgtctttg

SEQ ID NO: 34 - DNA, 25 bp, Artificial Sequence
  misc_feature (1): The residue at this position is linked to a fluorescein label.; Description of Artificial Sequence:  Synthetic
agcgagacagcgaaagacgctcgtt

SEQ ID NO: 35 - DNA, 26 bp, Artificial Sequence
  Description of Artificial Sequence:  Synthetic
ucacggcaguuggugcggaacgcacg

SEQ ID NO: 36 - DNA, 26 bp, Artificial Sequence
  Description of Artificial Sequence:  Synthetic
tcacggcagttggtgcggaacgcacg

SEQ ID NO: 37 - DNA, 36 bp, Artificial Sequence
  Description of Artificial Sequence:  Synthetic
cacgaattcggggatgctgcccctctttgagcccaa

SEQ ID NO: 38 - DNA, 34 bp, Artificial Sequence
  Description of Artificial Sequence:  Synthetic
gtgagatctatcactccttggcggagagccagtc

SEQ ID NO: 39 - DNA, 2502 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccagggggggccgggtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttccaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccacatggaggccacgggggtgcgcctggacgtggcctatctcagggccttgtccctggaggtggccggggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccggggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggagtga

SEQ ID NO: 40 - protein, 833 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAGEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVRGTAADLMKLAMVKLFPRLEEMGARMLLQVHDELVLEAPKERAEAVARLAKEVMEGVYPLAVPLEVEVGIGEDWLSAKE

SEQ ID NO: 41 - DNA, 28 bp, Artificial Sequence
  Description of Artificial Sequence:  Synthetic
cacgaattccgaggcgatgcttccgctc

SEQ ID NO: 42 - DNA, 30 bp, Artificial Sequence
  Description of Artificial Sequence:  Synthetic
tcgacgtcgactaacccttggcggaaagcc

SEQ ID NO: 43 - DNA, 23 bp, Artificial Sequence
  Description of Artificial Sequence:  Synthetic
gcatcgcctcggaattcatggtc

SEQ ID NO: 44 - DNA, 30 bp, Artificial Sequence
  Description of Artificial Sequence:  Synthetic
atagccatggtggagcggccgctctcccgg

SEQ ID NO: 45 - DNA, 33 bp, Artificial Sequence
  Description of Artificial Sequence:  Synthetic
aagcgtcgactcaatcctgcttcgcctccagcc

SEQ ID NO: 46 - DNA, 32 bp, Artificial Sequence
  Description of Artificial Sequence:  Synthetic
aatcgaattcaccccactttttgacctggagg

SEQ ID NO: 47 - DNA, 21 bp, Artificial Sequence
  Description of Artificial Sequence:  Synthetic
ccgggagagcggccgctccac

SEQ ID NO: 48 - DNA, 2508 bp, Artificial Sequence
  Description of Artificial Sequence:  Synthetic
atggaattcaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcggagggccgggtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttccccggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgggccggacggagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtgcacgacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggattga

SEQ ID NO: 49 - DNA, 31 bp, Artificial Sequence
  Description of Artificial Sequence:  Synthetic
actggaattcctgcccctctttgagcccaag

SEQ ID NO: 50 - DNA, 30 bp, Artificial Sequence
  Description of Artificial Sequence:  Synthetic
aacagtcgacctaggccttggcggaaagcc

SEQ ID NO: 51 - DNA, 2499 bp, Artificial Sequence
  Description of Artificial Sequence:  Synthetic
atggaattcctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctgggagggaagggtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctggagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcggcaagacggagaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacgacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcctag

SEQ ID NO: 52 - DNA, 20 bp, Artificial Sequence
  Description of Artificial Sequence:  Synthetic
cgatctcctcggccacctcc

SEQ ID NO: 53 - DNA, 20 bp, Artificial Sequence
  Description of Artificial Sequence:  Synthetic
ggcggtgccctggacgggca

SEQ ID NO: 54 - DNA, 20 bp, Artificial Sequence
  Description of Artificial Sequence:  Synthetic
ccagctcgttgtggacctga

SEQ ID NO: 55 - DNA, 2505 bp, Thermus aquaticus
  CDS (1)..(2499)
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccagggggggccgggtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttccaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccacatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagtgatag

SEQ ID NO: 56 - protein, 833 aa, Thermus aquaticus
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKE

SEQ ID NO: 57 - DNA, 26 bp, Artificial Sequence
  Description of Artificial Sequence:  Synthetic
caggaggagctcgttgtggacctgga

SEQ ID NO: 58 - protein, 836 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKG

SEQ ID NO: 59 - DNA, 2511 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 60 - DNA, 50 bp, Artificial Sequence
  Description of Artificial Sequence:  Synthetic
tctagaggatctatcagtggtggtggtggtggtgctccttggcggagagc

SEQ ID NO: 61 - DNA, 58 bp, Artificial Sequence
  Description of Artificial Sequence:  Synthetic
tgcctgcaggtcgacgctagctagtggtggtggtggtggtgacccttggcggaaagcc

SEQ ID NO: 62 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccagggggggccgggtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttccaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccacatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 63 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 64 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 65 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 66 - DNA, 30 bp, Artificial Sequence
  Description of Artificial Sequence:  Synthetic
gccgccaggggcggccgcgtccaccgggcc

SEQ ID NO: 67 - DNA, 31 bp, Artificial Sequence
  Description of Artificial Sequence:  Synthetic
gcctgcaggggcggccgcgtgcaccggggca

SEQ ID NO: 68 - DNA, 26 bp, Artificial Sequence
  Description of Artificial Sequence:  Synthetic
ctcctggacccttcgaacaccacccc

SEQ ID NO: 69 - DNA, 23 bp, Artificial Sequence
  Description of Artificial Sequence:  Synthetic
gtcctggcccatatggaggccac

SEQ ID NO: 70 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 71 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 72 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 73 - protein, 839 aa, Artificial Sequence; identical to SEQ ID NO: 63
  Description of Artificial Sequence:  Synthetic

SEQ ID NO: 74 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 75 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 76 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 77 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 78 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 79 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 80 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 81 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 82 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 83 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 84 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 85 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 86 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 87 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 88 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 89 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 90 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 91 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 92 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 93 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 94 - DNA, 2499 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 95 - protein, 833 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 96 - DNA, 2499 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggag

SEQ ID NO: 97 - protein, 833 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKE

SEQ ID NO: 98 - DNA, 2499 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 99 - protein, 833 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 100 - DNA, 2499 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggag

SEQ ID NO: 101 - protein, 833 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKE

SEQ ID NO: 102 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcggggcaccgggccgccctttccgagaggctcttcgccaacctgtgggggaggcttgagggggaggagaggctcctttggctttaccgggaggtggagaggcccctttccgctgtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 103 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGHRAALSERLFANLWGRLEGEERLLWLYREVERPLSAVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 104 - DNA, 27 bp, Artificial Sequence
  Description of Artificial Sequence:  Synthetic
gaggaggcggggcaccgggccgccctt

SEQ ID NO: 105 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctccatcggaacctgtgggggaggcttgagggggaggagaggctcctttggctttaccgggaggtggagaggcccctttccgctgtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 106 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLHRNLWGRLEGEERLLWLYREVERPLSAVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 107 - DNA, 36 bp, Artificial Sequence
  Description of Artificial Sequence:  Synthetic
ctttccgagaggctccatcggaacctgtgggggagg

SEQ ID NO: 108 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 109 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 110 - DNA, 36 bp, Artificial Sequence
  Description of Artificial Sequence:  Synthetic
ctcttcgccaacctgcttaagaggcttgagggggag

SEQ ID NO: 111 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 112 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 113 - DNA, 27 bp, Artificial Sequence
  Description of Artificial Sequence:  Synthetic
aggcccctttcccgggtcctggcccat

SEQ ID NO: 114 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgccgggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 115 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 116 - DNA, 27 bp, Artificial Sequence
  Description of Artificial Sequence:  Synthetic
acgggggtgcgccgggacgtggcctat

SEQ ID NO: 117 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctccaggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 118 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLQALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 119 - DNA, 27 bp, Artificial Sequence
  Description of Artificial Sequence:  Synthetic
gtggcctatctccaggccttgtccctg

SEQ ID NO: 120 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggagcttgccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 121 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLELAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 122 - DNA, 27 bp, Artificial Sequence
  Description of Artificial Sequence:  Synthetic
ttgtccctggagcttgccgaggagatc

SEQ ID NO: 123 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatccgccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 124 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIRRLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 125 - DNA, 27 bp, Artificial Sequence
  Description of Artificial Sequence:  Synthetic
gccgaggagatccgccgcctcgaggcc

SEQ ID NO: 126 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggaggaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 127 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEEEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 128 - DNA, 27 bp, Artificial Sequence
  Description of Artificial Sequence:  Synthetic
gcccgcctcgaggaggaggtcttccgc

SEQ ID NO: 129 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctaaggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 130 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELRLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 131 - DNA, 27 bp, Artificial Sequence
  Description of Artificial Sequence:  Synthetic
tttgacgagctaaggcttcccgccatc

SEQ ID NO: 132 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 133 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 134 - DNA, 27 bp, Artificial Sequence
  Description of Artificial Sequence:  Synthetic
atcgccaagacgcaaaagaccggcaag

SEQ ID NO: 135 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagcaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 136 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQHRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 137 - DNA, 27 bp, Artificial Sequence
  Description of Artificial Sequence:  Synthetic
aagatcctgcagcaccgggagctcacc

SEQ ID NO: 138 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagaacacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 139 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKNTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 140 - DNA, 27 bp, Artificial Sequence
  Description of Artificial Sequence:  Synthetic
accaagctgaagaacacctacattgac

SEQ ID NO: 141 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacgtggaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 142 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYVDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 143 - DNA, 27 bp, Artificial Sequence
  Description of Artificial Sequence:  Synthetic
aagagcacctacgtggaccccttgccg

SEQ ID NO: 144 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccgagcctcgtccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 145 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 146 - DNA, 39 bp, Artificial Sequence
  Description of Artificial Sequence:  Synthetic
attgaccccttgccgagcctcgtccaccccaggacgggc

SEQ ID NO: 147 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 148 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 149 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttgggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 150 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLGRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 151 - DNA, 33 bp, Artificial Sequence
  Description of Artificial Sequence:  Synthetic
ttcgccaacctgcttgggaggcttgagggggag

SEQ ID NO: 152 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtggaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 153 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 154 - DNA, 33 bp, Artificial Sequence
  Description of Artificial Sequence:  Synthetic
ctcttcgccaacctgtggaagaggcttgagggg

SEQ ID NO: 155 - protein, 835 aa, Artificial Sequence
  Description of Artificial Sequence:  Synthetic
MEFTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASEGRVHRATSPVEALADLKEARGFLAKDLAVLALREGVALDPTDDPLLVAYLLDPANTHPEGVARRYGGEFTEDAAERALLSERLFQNLFPRLSEKLLWLYQEVERPLSRVLAHMEARGVRLDVPLLEALSFELEKEMERLEGEVFRLAGHPFNLNSRDQLERVLFDELGLTPVGRTEKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVHDELVLEVPEDRAEEAKALVKEVMENAYPLDVPLEVEVGVGRDWLEAKQD

SEQ ID NO: 156 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatcgccacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 157 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIATQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 158 - DNA, 33 bp, Artificial Sequence
  Description of Artificial Sequence:  Synthetic
gcttgcggtctgggtggcgatgtccttcccctc

SEQ ID NO: 159 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggaggccatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 160 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAEAMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 161 - DNA, 33 bp, Artificial Sequence
  Description of Artificial Sequence:  Synthetic
catgttgaaggccatggcctccgcggcctccct

SEQ ID NO: 162 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 163 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 164 - DNA, 30 bp, Artificial Sequence
  Description of Artificial Sequence:  Synthetic
caggaggagctcgttggcgacctggaggag

SEQ ID NO: 165 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 166 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 167 - DNA, 45 bp, Artificial Sequence
  Description of Artificial Sequence:  Synthetic
ggagcgcttgcctgtcttcttcgtcttcttcaaggcgggaggcct

SEQ ID NO: 168 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 169 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 170 - DNA, 33 bp, Artificial Sequence
  Description of Artificial Sequence:  Synthetic
gaggaccagctcgttggcgacctgaaggagcat

SEQ ID NO: 171 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatcgccacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 172 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIATETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 173 - DNA, 33 bp, Artificial Sequence
  Description of Artificial Sequence:  Synthetic
gaggggcgggacatcgccacggagaccgccagc

SEQ ID NO: 174 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtcgccaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 175 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVATPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 176 - DNA, 33 bp, Artificial Sequence
  Description of Artificial Sequence:  Synthetic
cagaacatccccgtcgccaccccgcttgggcag

SEQ ID NO: 177 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 178 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 179 - DNA, 33 bp, Artificial Sequence
  Description of Artificial Sequence:  Synthetic
gggcttcccgccatcaagaagacggagaagacc

SEQ ID NO: 180 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacgaggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 181 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYEGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 182 - DNA, 39 bp, Artificial Sequence
  Description of Artificial Sequence:  Synthetic
ctagggcttcccgccatcaagaagacgcaaaagaccggc

SEQ ID NO: 183 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggccgagacggaggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 184 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAETEEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 185 - DNA, 39 bp, Artificial Sequence
  Description of Artificial Sequence:  Synthetic
ccggggaaagtcctcctccgtctcggcccggcccgcctt

SEQ ID NO: 186 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 187 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 188 - DNA, 36 bp, Artificial Sequence
  Description of Artificial Sequence:  Synthetic
cgggacctcgaggcgcgtgaaccccaggaggtccac

SEQ ID NO: 189 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 190 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 191 - DNA, 18 bp, Artificial Sequence
  Description of Artificial Sequence:  Synthetic
ctcctccacgagttcggc

SEQ ID NO: 192 - DNA, 48 bp, Artificial Sequence
  Description of Artificial Sequence:  Synthetic
accggtcttcttcgtcttcttcaacttgggaagcctgagctcgtcaaa

SEQ ID NO: 193 - DNA, 33 bp, Artificial Sequence
  Description of Artificial Sequence:  Synthetic
aagacgaagaagaccggtaagcgctccaccagc

SEQ ID NO: 194 - DNA, 52 bp, Artificial Sequence
  Description of Artificial Sequence:  Synthetic
gtcgactctagatcagtggtggtggtggtggtgcttggccgcccggcgcatc

SEQ ID NO: 195 - DNA, 60 bp, Artificial Sequence
  modified_base (19)..(42): The bases in these positions within this primer are 9137706720644f the base shown and 3 4.222698e-312ach of the other 3 nucleotides.; Description of Artificial Sequence:  Synthetic
ggagcgcttaccggtcttttgcgtcttcttgatcttgggaagccttagctcgtcaaagag

SEQ ID NO: 196 - DNA, 18 bp, Artificial Sequence
  Description of Artificial Sequence:  Synthetic
ctcctccacgagttcggc

SEQ ID NO: 197 - DNA, 60 bp, Artificial Sequence
  modified_base (19)..(42): The bases at these positions within this primer are 9137706720644f the base shown and 3 4.222698e-312ach of the other 3 nucleotides.; Description of Artificial Sequence:  Synthetic
caaaagaccggtaagcgctccaccagcgccgccgtcctggaggccctccgcgaggcccac

SEQ ID NO: 198 - DNA, 52 bp, Artificial Sequence; identical to SEQ ID NO: 194
  Description of Artificial Sequence:  Synthetic

SEQ ID NO: 199 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctaaggcttcccaagatcaacaagacgaagaagaccggtaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 200 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKINKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 201 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctaaggattcccaagatcaagaagacgcataagaccggtaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 202 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRIPKIKKTHKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 203 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 204 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 205 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccaccagcgccgccctcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 206 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSTSAALLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 207 - DNA, 21 bp, Artificial Sequence
  Description of Artificial Sequence:  Synthetic
gtcggaggggtcccccacgag

SEQ ID NO: 208 - DNA, 17 bp, Artificial Sequence
  Description of Artificial Sequence:  Synthetic
tgtggaattgtgagcgg

SEQ ID NO: 209 - DNA, 75 bp, Artificial Sequence
  modified_base (28)..(59): The bases in these positions within this primer are 9137706720644f the base shown and 3 4.222698e-312ach of the other 3 nucleotides.; Description of Artificial Sequence:  Synthetic
ctcgtgggggacccctccgacaacctccccggggtcaagggcatcggggagaagaccgccctcaagcttctcaag

SEQ ID NO: 210 - DNA, 23 bp, Artificial Sequence
  Description of Artificial Sequence:  Synthetic
gtggcctccatatgggccaggac

SEQ ID NO: 211 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccgaggggtcaggggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 212 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLRGVRGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 213 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagtataccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 214 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEYTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 215 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcagggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 216 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIREKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 217 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 218 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 219 - DNA, 36 bp, Artificial Sequence; identical to SEQ ID NO: 188
  Description of Artificial Sequence:  Synthetic

SEQ ID NO: 220 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggccgagacggaggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 221 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAETEEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 222 - DNA, 39 bp, Artificial Sequence; identical to SEQ ID NO: 185
  Description of Artificial Sequence:  Synthetic

SEQ ID NO: 223 - DNA, 24 bp, Artificial Sequence
  Description of Artificial Sequence:  Synthetic
gtcggactcgtcaccggtcagggc

SEQ ID NO: 224 - DNA, 75 bp, Artificial Sequence
  modified_base (28)..(60): The bases in these positions within this primer are 9137706720644f the base shown and 3 4.222698e-312ach of the other 3 nucleotides.; Description of Artificial Sequence:  Synthetic
ctgaccggtgacgagtccgacaaccttcccggggtcaagggcatcggggagaggacggcgaggaagcttctggag

SEQ ID NO: 225 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaatggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 226 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVNGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 227 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacgcagaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 228 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTQRKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 229 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatgggggagaagacggggaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 230 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGMGEKTGRKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 231 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaatacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 232 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGENTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 233 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagccggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 234 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKPARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 235 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccacgccctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 236 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHALSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 237 - DNA, 33 bp, Artificial Sequence
  Description of Artificial Sequence:  Synthetic
tagctcctgggagagggcgtgggccgacatgcc

SEQ ID NO: 238 - DNA, 2517 bp, Artificial Sequence
  Description of Artificial Sequence:  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 239 - protein, 839 aa, Artificial Sequence
  Description of Artificial Sequence:  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 240 - DNA, 2526 bp, Artificial Sequence
  Description of Artificial Sequence:  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 241 - protein, 842 aa, Artificial Sequence
  Description of Artificial Sequence:  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 242 - DNA, 2508 bp, Artificial Sequence
  Description of Artificial Sequence:  Synthetic
atggaattcaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcggagggccgggtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgggccggacgcagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtgcacaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggattga

SEQ ID NO: 243 - protein, 835 aa, Artificial Sequence
  Description of Artificial Sequence:  Synthetic
MEFTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASEGRVHRATSPVEALADLKEARGFLAKDLAVLALREGVALDPTDDPLLVAYLLDPANTHPEGVARRYGGEFTEDAAERALLSERLFQNLFKRLSEKLLWLYQEVERPLSRVLAHMEARGVRLDVPLLEALSFELEKEMERLEGEVFRLAGHPFNLNSRDQLERVLFDELGLTPVGRTQKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVHNELVLEVPEDRAEEAKALVKEVMENAYPLDVPLEVEVGVGRDWLEAKQD

SEQ ID NO: 244 - DNA, 34 bp, Artificial Sequence
  Description of Artificial Sequence:  Synthetic
cttccagaacctctttaaacggctttccgagaag

SEQ ID NO: 245 - DNA, 34 bp, Artificial Sequence
  Description of Artificial Sequence:  Synthetic
cttctcggaaagccgtttaaagaggttctggaag

SEQ ID NO: 246 - DNA, 31 bp, Artificial Sequence
  Description of Artificial Sequence:  Synthetic
ccggtgggccggacgcagaagacgggcaagc

SEQ ID NO: 247 - DNA, 31 bp, Artificial Sequence
  Description of Artificial Sequence:  Synthetic
gcttgcccgtcttctgcgtccggcccaccgg

SEQ ID NO: 248 - DNA, 31 bp, Artificial Sequence
  Description of Artificial Sequence:  Synthetic
ctcctccaagtgcacaacgagctggtcctgg

SEQ ID NO: 249 - DNA, 31 bp, Artificial Sequence
  Description of Artificial Sequence:  Synthetic
ccaggaccagctcgttgtgcacttggaggag

SEQ ID NO: 250 - DNA, 2499 bp, Artificial Sequence
  Description of Artificial Sequence:  Synthetic
atggaattcctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctgggagggaagggtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctgaagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcggcaagacgcagaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacaacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcctag

SEQ ID NO: 251 - protein, 832 aa, Artificial Sequence
  Description of Artificial Sequence:  Synthetic
MEFLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWEGRVYRAEDPLEALRGLGEVRGLLAKDLAVLALREGIALAPGDDPMLLAYLLDPSNTAPEGVARRYGGEWTEEAGERALLSERLYAALLKRLKGEERLLWLYEEVEKPLSRVLAHMEATGVRLDVAYLKALSLEVEAEIRRFEEEVHRLAGHPFNLNSRDQLERVIFDELGLPAIGKTQKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHNELVLEAPKEQAEEVAQEAKRTMEEVWPLKVPLEVEVGIGEDWLSAKA

SEQ ID NO: 252 - DNA, 26 bp, Artificial Sequence
  Description of Artificial Sequence:  Synthetic
gccgccctcctgaagcggcttaaggg

SEQ ID NO: 253 - DNA, 26 bp, Artificial Sequence
  Description of Artificial Sequence:  Synthetic
cccttaagccgcttcaggagggcggc

SEQ ID NO: 254 - DNA, 28 bp, Artificial Sequence
  Description of Artificial Sequence:  Synthetic
atcggcaagacgcagaagacgggcaagc

SEQ ID NO: 255 - DNA, 28 bp, Artificial Sequence
  Description of Artificial Sequence:  Synthetic
gcttgcccgtcttctgcgtcttgccgat

SEQ ID NO: 256 - DNA, 27 bp, Artificial Sequence
  Description of Artificial Sequence:  Synthetic
ttgcaggtgcacaacgaactggtcctc

SEQ ID NO: 257 - DNA, 27 bp, Artificial Sequence
  Description of Artificial Sequence:  Synthetic
gaggaccagttcgttgtgcacctgcaa

SEQ ID NO: 258 - DNA, 2526 bp, Artificial Sequence
  Description of Artificial Sequence:  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 259 - protein, 842 aa, Artificial Sequence
  Description of Artificial Sequence:  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 260 - DNA, 2514 bp, Artificial Sequence
  Description of Artificial Sequence:  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 261 - protein, 838 aa, Artificial Sequence
  Description of Artificial Sequence:  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 262 - DNA, 2526 bp, Artificial Sequence
  Description of Artificial Sequence:  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 263 - protein, 842 aa, Artificial Sequence
  Description of Artificial Sequence:  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 264 - DNA, 2514 bp, Artificial Sequence
  Description of Artificial Sequence:  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 265 - protein, 838 aa, Artificial Sequence
  Description of Artificial Sequence:  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 266 - DNA, 2505 bp, Thermus thermophilus
atggaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 267 - protein, 834 aa, Thermus aquaticus
MEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 268 - protein, 832 aa, Artificial Sequence
  Description of Artificial Sequence:  Synthetic
MEFLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWEGRVYRAEDPLEALRGLGEVRGLLAKDLAVLALREGIALAPGDDPMLLAYLLDPSNTAPEGVARRYGGEWTEEAGERALLSERLYAALLERLKGEERLLWLYEEVEKPLSRVLAHMEATGVRLDVAYLKALSLEVEAEIRRFEEEVHRLAGHPFNLNSRDQLERVIFDELGLPAIGKTEKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHDELVLEAPKEQAEEVAQEAKRTMEEVWPLKVPLEVEVGIGEDWLSAKA

SEQ ID NO: 269 - DNA, 63 bp, Artificial Sequence
  Description of Artificial Sequence:  Synthetic
gcgcggcggcgggtgtggtggttacgcgcagcgtgaccgctacacttgccagcgccctagcgc

SEQ ID NO: 270 - DNA, 30 bp, Artificial Sequence
  Description of Artificial Sequence:  Synthetic
gcgctagggcgctggcaagtgtagcggtca

SEQ ID NO: 271 - DNA, 35 bp, Artificial Sequence
  Description of Artificial Sequence:  Synthetic
gatcgctgcgcgtaaccaccacacccgcgccgcgc

SEQ ID NO: 272 - DNA, 30 bp, Artificial Sequence
  Description of Artificial Sequence:  Synthetic
ggactctgcctcaagacggtagtcaacgtg

SEQ ID NO: 273 - DNA, 16 bp, Artificial Sequence
  Description of Artificial Sequence:  Synthetic
cacgttgactaccgtc

SEQ ID NO: 274 - DNA, 34 bp, Artificial Sequence
  Description of Artificial Sequence:  Synthetic
catgtcaagcagtcctaactttgaggcagagtcc

SEQ ID NO: 275 - DNA, 36 bp, Artificial Sequence
  Description of Artificial Sequence:  Synthetic
cagaccatgaattccaccccactttttgacctggag

SEQ ID NO: 276 - DNA, 36 bp, Artificial Sequence
  Description of Artificial Sequence:  Synthetic
gtggacgcggccgcccgaggccgccgccagggccag

SEQ ID NO: 277 - DNA, 36 bp, Artificial Sequence
  Description of Artificial Sequence:  Synthetic
cagaccatgaattccctgcccctctttgagcccaag

SEQ ID NO: 278 - DNA, 36 bp, Artificial Sequence
  Description of Artificial Sequence:  Synthetic
gtaaaccgcgccgccccaggcggcggccaaggcgtt

We claim:

1. A composition comprising a polymerase comprising a 5' nuclease, wherein said polymerase comprises a heterologous functional domain, wherein said heterologous functional domain comprises an amino acid sequence that provides improved background specificity in a nucleic acid cleavage assay compared to said polymerase enzyme without said heterologous functional domain.

2. The composition of claim 1, wherein said 5' nuclease comprises a thermostable 5' nuclease.

3. The composition of claim 1, wherein said polymerase is altered in sequence relative to a naturally occurring sequence of a polymerase such that it exhibits reduced DNA synthetic activity from that of the naturally occurring polymerase.

4. The composition of claim 1, wherein said polymerase comprises a thermostable polymerase.

5. The composition of claim 4, wherein said thermostable polymerase comprises a polymerase from a Thermus species.

6. The composition of claim 5 wherein said Thermus species is selected from the group consisting of *Thermus aquaticus, Thermus flavus, Thermus thermophilus, Thermus filiformus*, and *Thermus scotoductus*.

7. The composition of claim 1, wherein said heterologous functional domain comprises an amino acid sequence that provides an improved substrate binding activity in said nucleic acid cleavage assay.

8. The composition of claim 1, wherein said heterologous functional domain comprises two or more amino acids from a polymerase domain of a second polymerase.

9. The composition of claim 8, wherein at least one of said two or more amino acids is from a palm region of said polymerase domain of said second polymerase.

10. The composition of claim 8, wherein at least one of said two or more amino acids is from a thumb region of said polymerase domain of said second polymerase.

11. The composition of claim 8, wherein said second polymerase comprises *Thermus thermophilus* polymerase.

12. The composition of claim 1, wherein said nucleic acid cleavage assay comprises cleavage of a DNA member of a substrate containing at least one RNA component.

13. The composition of claim 1, wherein said nucleic acid cleavage assay comprises an invasive cleavage assay.

14. A kit comprising the composition of claim 1.

15. The kit of claim 14, further comprising at least one nucleic acid cleavage substrate.

16. The kit of claim 15, further comprising at least one RNA capable of hybridizing to said nucleic acid cleavage substrate.

17. The kit of claim 14, further comprising a labeled oligonucleotide.

18. The kit of claim 14, further comprising an invasive oligonucleotide.

19. A method for cleaving a nucleic acid comprising:
 a) providing:
  i) the composition of claim 1; and
  ii) a substrate nucleic acid; and
 b) exposing said substrate nucleic acid to said enzyme.

20. The method of claim 19, wherein said exposing said substrate nucleic acid to said enzyme produces at least one cleavage product.

21. The method of claim 20, further comprising the step of c) detecting said cleavage product.

* * * * *